United States Patent 10,524,471 (COMPOSITIONS AND METHODS FOR INCREASING SALT TOLERANCE IN PLANTS) - sequence listing, part 2

SEQ ID NO: 2 - DNA, 703280 bp, Enterobacter sp SA187
ctggcggcactagcgcggcggtcccacctgaccccatgccgaactcagaagtgaaacgccgtagcgccgatggtagtgtggggtctccccatgcgagagtagggaactgccaggcatcaaattaagcgtgctgatatggctcagttggtagagcgcacccttggtaagggtgaggtccccagttcgactctgggtatcagcaccacttttaaagcggttaatagttcggcacttagaaaagaatttgcctggcgacactagcgcggcggtcccacctgaccccatgccgaactcagaagtgaaacgccgtagcgccgatggtagtgtggggtctccccatgcgagagtagggaattgccaggcatcaaataaagcaaaaagcccagtcgaaagactgggctttttgctatggatcttttctggaaataaccgcaaagcctggcgcggcggctgggctttgcggttatagaagccagattaatgaataacctgcgacaaaaatgctcttgtacgttctgatttggggttggcaaagaaggtttctggcggtgcctgttcaacgatttcaccacgatccataaagatcacgcgatccgctacggtacgggcaaagcccatctcatgggtcacgcagagcatggtcatacccgactcggcaaggccaatcatcgtatccagcacctctttcaccatctccgggtcgagcgcagaagtcggttcgtcgaacagcatgattttcggtttcatacacagcgaacgagcaatggctacgcgctgttgctgcccgccggaaatctgccccggaaatttatgggcatgttcagcaatacgcacgcgttcaagataatgcatcgccagtgcttccgcttccttcttcggcattttacgcacccagatcggtgccagcgtgcagttctgtaaaaccgtcagatgcgggaacaggttgaaatgctggaacaccatgcccacttcctgacgcaccttttcgatattacggatgtcctcgttaagctcaatcccatccaccacaatccggccttgctgatgctcttccagatggttgatacagcggatcgtggtggatttccctgaacccgacggcccgcagaggacaatacgttcaccctgtttgacctcaaggttgatatttttcagcacgtgaaactgcccgtaccatttattcacagtgtcgagcgtaatcatcgcatcgtcagactgcataatcatattactcatggttttcctcagtgcgctgtacgcccggtgttgaaacgcttctccagatgctggctgtagcgtgacatgctaaaacagaaaatccagtaaaccagcgcggcaaagacatagccctcggtcgacatgccaagccatgccggatcgaccgtggcctgctgcacgctgctgaacagatcaaaaagcccgatgatgatcaccagactggtatctttaaatagcgcgataatggtattaaccagacccgggatcaccagtttcagcgcctggggcaatatgaccagcccctgtgttttccagtaaccaagggccagcgattccgccgcttcatactgacccttcggcaatgcctgaagcccgccgcgtaccacttccgccacataagccgactgaaaaagcaccacgccaaccagcgcacggatgagcttatctatgcttgttccttcagacataaacagcggcagcattactgacgacataaacagcacggtaatcagcggcacgccacgccagaactcgataaatatcaccgacaggatccgcaccactggcatttttgaacgccgccccaaggccagtaagatgcccaacggcaaagcaccggcgataccgaccgcggcgatgattagcgtcagcgttaatccgccccattgacgggtttccacccgctcaagccctaaaaatcctccatacaacaaccaccacaccacgaccggatagataactgcccagcaggcgatataacggccacgcctgggcagtgttttcaaaaacatcggcgcgatagagagcagaccaaagattaaggcaacattgatccgccagcgctgctcatgggggtaaaggccatacataaactgcccaaaccgctgatggataaatacccagcaggcgccttccttcgtacaatccgcgcgggtcgttcccacccagtttgcctggaataacacccagttaagcaatggcgggatcagctcccacatcagccacaggcagaacagcgtcagcagtgtgtttgaccagctggagaaaaggttcttacgtacccaaagtaaataatgccccgtcccggtactgaccggacgcggcgagtgagacacaatagcttttgtcatcacggatccttagcgttcaatcagcgcaatgcggcggttatagatattcatcagcaacgaaataccgagactgataatcaggtataccgacatagtgatggcgatagtttcaattgcctggcctgtctggttcaggacggttcccgcgaaaagcgacaccatgtccggataaccaatcgccgccgccagagatgagtttttgacgatattaagatactggctggttaatggcgggatgatcacacgcagcgcctgcgggatgatcacctggcgtagcgttaccggatgcggcaggccaagcgaacgcgccgcttcgtgctgcccgtgcggtactgactgaatacccgcgcggataatctcggcaataaaggcggaggtatagactgacagggccagcgtcaatgctgccagttccgggatcagcgccattccgccacggaagttaaaaccgcgcagttccggcacatcccagtgcagggccgccccgaaaatcatgtgcgccagcagtggcaatgcgatgaaaagaccaagtgcaaccggccatgtgcggcgtagttgcccggttttgatctgatgcgttttattaaagcggaacaggccaaccgacaggacaactgccagcgcgactgccgcgataaaagccagcagcccttcacctgtttgcggcgcgggaatatagagaccacgattgctcaaaaacgccaggtcgaacgcgcttaccgcctggcgtggccccggaagattacgcagtaccgcaaagtaccagaagaagatctgtaataacggcggaatattgcggaacgtctcgatgtaaatagtcgacagtttacgcagcagccagttttccgacagtcgtgcaagccccagaaagaagcccagaaatgaggcaaaaacaatgcatagcgccgataccagcagcgtattaagcaaaccgaccaggaacacccggccataagtatcgccctgctcataatcgataagatgctgaacaatgccgaaaccggcgctgcgatcgaggaaggcaaaacctgacgtgatgccacggttgctcagattggtaacggtattgtgtatcaggtaaatagccacgccgacgacagccagcacggcgataatctgaaacagccaggcgcgaaccgcagggttggagaaggaaaacgatcctttaacggttgggcggcgatgggacataagaaaacctcggtagccatgactctggaccggacaccgcaaaggcggtgtccgttactgcaaaatacaaaatgtcaggtcttaacgtactggcggagcgtactgaataccgccgttattccagaggttgttctgaccacgtttgattttcagtgggctttcagaacccacattacgttcgaacacttccgcatagttaccgactttcttgatgatgttataagcccatttgttatcaagcttcagatccttgccgtaatcaccctctttgcccagcagatgcgccatatcaggcgtggccggattcgccgctttctcatcgacgtttttagaggtaacacccatctcttccgcattcagcatggcgaacagcgtccagcgcacaatggagaaccactcatcatcaccgcggcgaaccaccgggcccagcggctctttagaaatcacttccggcagaacaatccactcgcccggcgtgctcagcttaatgcgcagcgcatagagctgagactggtcggaggccagcgtatcgcaacgacctgattccagcgccttggcggattcatcagaacggtcaaaggtcaccggcgtatagttcattttgttggatttgaaataatccgccacgttcagctcggtgtctgtacctgcctgaatacagacggtggcaccatccagctctttggcgcttttaaggcccgctttgttgtgggtcaggaagccgataccgtcatagtaggtgacgccggtaaaggacattcccatgcctgcatcacgggaggaggtccaggtcgtattacgggagagtacatccacttcacccgactgcaacgcagtgaagcgctcttttgccgtcagcggggtatattttacttttgtatcatcgccgaaaacggcagccgcaacgccacggcacacatccacatcaataccgctaaatttaccgttggcgtctgcataagagaaacccggcaacccgtcactaataccgcactgcacaaaaccttttttctttactgcatccagagtggcaccagcatgggcctgattagcaacagcaaacagcgcaccggcagcggccaggctggcgatcatcatctttttcataatgcatcctgtgtggcgaaattatcgttatatgaaggcgtccgggaaacgcctgaaacctgtctgtggctttggccatactttgtaaagcaaaggtagtgccaggttttacgtgcgaaaagaattaatgcagaacgcccgtaataaggagagtgtagacagggaaaaataaaatcagcgcactggattggtgcgaaattaaaacctgtgccacaaatcagagcaaaataaattcatagcagacgaaccattggtgggatgaatcatttatacaggaaagggggaagaaaataatgacccaaagtaagagataattttaacaatgttgatggattgcaccggacgggagcaaaagcaggcgtacaccggcacgcctgcgagaagattatttggtgagagcgacgatacccagggtcacgccagcaatggccgcagcgccgcctgcgatagcgcctgccgtttcccagttatcctgcgtggtgcctttcatgcaggtattagtgtgcaccaggcggccctgatcgtcatagacggggacacaaggggaatcgtgagcacacccggccagtacggaagacaacagtgcaatggcaattaattttttcatgatcacaattacctcttttgtgtgaatgcgttcattctaccactggttagcacgccttcctgcggctggagttttacaaagcatgtcgaatgtaaaaagcgtggagataaagccgccagaatggtgagattatggagaaatagaggatgtgcgcagggacaatgatgtacatgagtgatggtttaccggcgcagagggcgtaaggcgaagcgatgccagcagtccgtccaccagcgacggagccagtctgtcgagatcaaagcttttgtccgtcatgagccagtttttgatgataccgctcaggtaggcctgaataataatcatcgccaggtctatattacagttcagaaaccctgggttttcttttaagcatttattcaacatctgcaaaacatgttcatgattaaacaacagacgctcgcgtatctctgtttctgatgtcagctcttttgtaaactcgcatttatggtaaagaatttccaccagcgcctgttccagcggatcctgagcaatcagccgtaaaccttctattagtgattgtcgtaatattatttcggcagatgcgtccgaatgtaacttcattttatcggctattttatccctcacaggtaattgttcttgccagatagcgttaaataattgtgatttattttcaaagtgccagtaaatagcgccgcgtgttacttgcgctgcatgggctatatcatccagcgatgtgccagagaatccttgttgagaaaaggttaaaatggcggtgtcaattaataattgccgtgtttttaaggcatcctctttcgttctttttgccatgaataataactatgctgaatgatgggttacatttgctaaatgaaatttccgcaaaaaattgaatttgtatccttgcatttttctactattcattcaacatgtcgaggctatttttattgccgtcctctttatattcatcgcataaatataaagagggatgtttttattttagtgctgacgcgggtcggtgaatgcgaacagatataaggtgaaccgctaccatggctaagttctttattgataggcctatattcgcctgggtgctggcgattattttaatgctggctggtgcgctggcggtcatcaaccttccggttgcacaatatcctacgatcgcaccgcctgctatcgctattaatgccacttatcccggcgctgatgcgcaaacggtccaggataccgttacccaggtgatagaacaaaatatgaatggcctggataacctgatgtatatgtcgtccaccagcgattctgccggcagcgtgtccgtcaccttaacctttaaatccggcaccgatgccgatatcgcccaggttcaggtccagaacaaactgcaacttgctatgccattattgccccaggaagtgcagcaacaggggataaacgttaagaaatcaagcagcacctttttgatggtaatgggttttatctcagaagacggcagcatgacgcaggatgatattgccgattttatctcgtcaaatattaaggatcccgttagccgtactgaaggggtgggcgacgtgcagctattcggcgcgcaatatgcaatgcgcatctggcttgatccgaacaaactgaatgaatatcagttgactactgtcgatgtggtcgatcagatcaaagcccagaatagccagattgccgcaggccagctgggcggcacgccatccgtggccaatcagcagattaacgcctcgatcattgcccagacgcgtctgcgtacgccggagcagtttggccgtattacgttaaaagtcctctccaacggcgcacgggtacagctcaaagacgtcgcacgcatcgagctgggcggcgagaactacaacgttatcgcccggtataacggtaaaccgtcagcgggtctgggcatcaaactcgcaacgggcgctaacgcgctggacgccgccgatgcggtgaaacagcagatggcccacctgcaaccctactttcctcacggcctgaaactggtttacagctacgacaccaccccctttattaagatctccatccgggaagtcttcaaaacgctgtttgaagccatcgtgctggtgtttcttgtcatgtatctgtttttgcagaatctgcgggccacgctcattcctactattgcggtgcccgtggtgttactggggacctttgccatactggcggcgttcggctattcgattaacacgctgaccatgtttggcatggtgttagccatcggcctgctggtggacgacgctatcgtggtggtggaaaacgtagagcgcgtgatggtcgatgaaggattgccccccaaagaggcgacgcagaaatcgatggcgcagatacagggcgcgctggtgggcatcgccatggtgttgtcggcggtattcgtcccgatggcgttttttggcggctcaaccggggtgatctaccggcaattctccatcaccatcgtttctgccatggctctgtccgtgctggtggcgctcattttaacgcccgcactgtgcgccaccctgctaaaacccactacccacggcacgactaaccggatgtttggctggttcaaccggctgtttgaacaaagcacccagcactacaccggcagcgtacagaaactgctaagccgtaccggccgctacatggtgctttacctggtgattgtcgtgggcatggcctgtttattcctgcgtttgcccacctcttttttacccgaagaggatcaaggggttttcctgacgatggtcacgctgcccgctggcgccgcccaggatcgcacggaaaaaatcatgcaggaagtcacacgttactatctgacgaatgagaaaaataacgtggattctgtgtttacggtgacgggctttgggcttaacggtaaagggcaaaacaacggcctggcttttatccgtttaacagactgggcacagcgtgaaggcgaggaaaaccgtgttgaggcgatagttgcgcgtgccacgcatgcgtttcgcagtatcaaagacgggatggtatttgcgtttaaccttcccgccattaccgagctgggcactgctaccgggttcgactttgaactgatcgatcaggcggggctggggcatgtggagttgaccaaagcgcgtaatgaactgctgaaaaaagtcgctcagcgtccggatatgctggtgcgtacacggcctaatggtctggaagatatgccgcaattcaaactgaatgtcgatcaggaaaaagcacaggcgctcggtgtctcgctaacggatatcaacaagaccattgcaaccgcactgggtagcacttacgtgaatgatttcgtcgataacggccgtgtgaaaaaagtttacgcacaggctgacgcgccttatcgcatgatgccggatgatattaaccgctggtttgtacgtagccgtaacggcgaaatggtgcccttttcaagtttcaccagcgccaactggatccagggatcgccacgtctggagcgctacaacggtttgccagcgatggaaattctgggtgaggccgcgccaggtaaaagcagcggtgaggccatgaagatgatggaggcgttcgccgcaacgctgccctccgggattggcttcgactggacggggatgtcgtatcaggagcgcttatccggcaatcaggcccccgcgttatatgccatctcactgatggtggtattcctgtgtctggcggcactttatgaaagctggtcgattccattttccgtcatgctggttgtaccgctcggcgtggtgggcgccttgctggcggccagttgccgtggcctgagtaacgacgtctatttccaggttggcctgctgaccaccattggattgtcggcaaagaatgccattttgatcgtcgagtttgccagggatttgatggataaagagcacaagagcttaatcgacgccacgctggaggcggtaaaaatgcgtttgcgcccgatactcatgacgtcactggcttttatccttggcgtaatgccgctggtgctcagtacaggcgcaggcagcggcgcacaaaacgcggttgggactggcgtaatgggcggtatggtatccgcaaccctgctggcaatattttttgtgccggtatttttcgtggttattcgccgacgctttaccagtaaccactaaatatattcactgaaattatttatataaatattcttatacaaggcgtttatatttaaaaggtgttatcgcgtcgcaaaggcgatatttacctcatggctttagttttaagtgccattatttgtggcttaggattcgacgtcatttacataaatagtgaattatttgtaggatacccgacccgctggttttatttttctacctgctttgcggcttatgccgcgcattgtgttttgaggaactgcaatgaataaatttggtgaatgtattcgcctttcatcagtcattattatgtcaatcggcttactttgcggttgtaatgataatgaaaacgcgccagctaaaatgccggatcccgaggtcagcgtctggcaggttaaagcagcccctctggcggtgacgacagaattaccgggacgaaccgaagcatttcgtattgcagaggtgcgtccgcaggtgagcggaattattctcaaacgtaattttgttgaaggcaacgatattaccgccggggactcgctgtatcagatcgatccggcaacctatcaggcggccttagcaagcgcgcagggcgaattagcgaaagccgaagccgctgcaagtatggcgcacttaacggtcaaacgttatgcgcctctggtagggacgcaatacgtcagccgtcaggaatatgacaccgccgttgccagcgcccggcaggcagacgccagcgtccaggccgcaaaagccgcagtagagacggcgcgtatcaatctggcctatacccgtgtcagttcccccatcagcggccgtatcggtaaatctgccgtcaccgaaggcgcgctggtaaccaacggtcaggcgacggcgctggccacggtgcagcaaatcgatccaatctatgttgatgtcacgcaatccagcagcgattttatgcgtctgaaacaggcggtggaacagggcaacctgcgcagacaggatggcaaagctgaggttgaactgctcacagagaacggtcaggtctatccgttaaagggtacgctggaattctcagatattaccgtcgaccagagcaccggctcgatcactatccgcgcggttttccccaatcctgatcacagcctccttccgggaatgtttgtgcgcgcacgccttgatgaaggtgttcagccagaagctattctggtgccgcagcagagcgtaacccgtaatgctcgcggcgatgccaccgtgatgctggtaaatgaaaaaaatcaggctgagcagcgcaacgtagttgcgactcaggctattggcgataaatggctcatttcggaggggctgaaagagggtgacaaggtgattgtcagcggcttgcagcgtgcccgtcctggcacccaagtgactatcgtgcctgcttcatcaggtgagtaaaaaacgcgttgcagtaatcgcgcttacgcagtgagagtcgtaaaagatgtcgaagttttttattgatcgtccgatttttgcctgggtgctgtcgatcatactgatgattgcgggtgtactggcaatcatgcaattacctgtggcgcagtatccaaccattgcaccgcctgcgatcgcaatcagcgcctcctacccgggggccgatgcgcaaacggtgcaggataccgtcacacaggttattgaacagaacatgaatggcatcgataacctgatgtacatgtcctcaaccagcgattccgcaggtggcgtaaccatcaccctgacctttaaatcagggactgaagcggatattgctcaggttcaggtgcagaacaagctacaactggcgatgccacttttgccgcaggaagtgcagcagcaggggatcagcgttgagaaagccagtagcagtttcctgatggtggtgggctttacctctgaaaacaaaagcctgaaccaggacgatatttctgactatgtcgcctctaacgttaaagatgccattagccgtaccaatggcgttggcgacgtacagcttttcggtgcgcagtatgcgatgcgtatctggctgaatgtcgacatgctcaataaatatcgtatgacgccggtggatgttgttaaccagctcaaagtgcaaaacgatcagattgccgccgggcagttgggtggaacgccttctgttcctaatcaacagctcaacgcctccatcattgcgcaaacgcgcctgaaagatccggagcaatttggtaacgtgacgctgcgcgtcaatgcggacggttcgcaggttcgcctgagagatgtggcccgcattgaactgggcggggaaaactataacaccgttacgaaaatcaacggtcaggatgcggcggcgataggtattaaactggcgacaggggcaaacgcccttgataccgcaagcgctatcaagaacaaattacaggagcttgctccttattttccgcagggtatgcaggttgtttatccgtatgacactacgcccttcgtgcagatttccattcacggagtgatcaaaaccctgttcgaagccatcatcctggttttcctggtgatgtacctgttcctgcaaaatatccgcgccacgctgatcccgaccatcgccgtgccggttgtgttgctgggcacctttgccgtcctctctgcttttggctattcgattaacacgctcaccatgttcgggatggtgctggcgatcggcctgctggtcgacgatgccattgtcgtcgtggagaacgttgagcgtgtgatggtagaagatcacctgccgccgagagaagccacccagaaatcaatggaacagatccagggcgcgctggtgggcatcgccatggtgctgtcggcggttttcattccaatggcattttttggcggttcaacgggtgaaatttatcgtcagttctcgatcactatcgtgtcagcaatggccctgtcggtactggttgcgctgattctcacgccggcgttatgcgccacgctgcttaagcccgtcgatccccatgcccatggtgataaaaaaggctttttcggctggttcaaccgtttgtttgaacgttgcaccagccattacaccgacagcgttggcggcattatcagaagtaccgggcgttacctgctggtgtatttcctgattgtggtgggcatggcggtgctgtttttacgcttaccgacgtcctttctgccggacgaagatcagggcgtctttatgaccatggtgcaactgccagccggggcaacccaggcacgtacgcagaaggtgctcgatcaggtgaccgattactacctgaacgatgaaaaagcgaacgtgaattcggtgctgacggtgaacggttttagtttcagcggtcaggggcagaactcgggaattgcctttatcagtcttaaaccatgggaagagcgtccaggtaaagaaaacgccgtagagggcattgtggcacgcgccactaaagccttcagccgtattcaggatggccaggtgtttccctttaacctgccgccgattgttgaacttggcacggcgacagggtttgacttcgagcttatcgatcaggccaaccttgggcatgatgcgctgacaaaagcacgtaaccagctgatggaaatggtacagcagcatcctgataaactggtgcgcgtacgacctaacggacttgaagataccccgcagttcaaacttgaagtggacattgaaaaagcccaggccttaggtatcgatctttctgatgttaatcagacgatctcaattgcgttggggggatcctacgttaatgacttcatcgatcatggacgcgtgaaaaaagtctacgttcaggccgatgcgaaattccgtatgctgccgggggatattaataatctctacgtgcgcagcagcaacggagaaatgacgcccttctcctcatttaccacctcaagttgggtttacggctcgccgcggctcgaacgctttaacggtctgccatctatggagatcctgggcgaggccgcccccggcaagagttcaggtgacgccatgctgttgatggaacaaatggcctcccggctgcccgccgggataggttacgactggacgggtatgtcatatcaggaacgtttgtccggcaaccaggcgcccgcgttatacgctatttcgctgatcgttgtcttcctgtgcctggcggcactctatgagagctggtcaatcccgttttccgtcatgctggtggtgccgcttggcgtgattggcgccttgctggcggcgatgatgcgcggcatgaataacgatgtctatttccaggtcggcctgttaaccactattggcctgtcggcgaaaaacgccattctgatcgtggagtttgccaaagatctgatggataaagaaggcaagggcgtgattgaagcgacgctggacgcggtgcgtatgcgtcttcgtccgatcctgatgacctcgctggcattcattctgggcgtcatgccgctggtgatcagctccggcgcaggcagcggtgcgcaaaacgccgtgggtaccggggtgctgggggggatgctgaccgccacgctgctggcgatcttctttgtgccggtattctttgtggtcgtacggcagtttttcacgaaaaaagccagataacggctaagcggccctggcctggttcacaggccggggcttttttattcgccagtacgacccaactgtgcggcttcctgagcggaaaccggcctgccgagcagaaaaccctgcagagtgttgcagcccagttctgtcaggaaggtctgctgcgcctcggtttccacaccttctgcgacaattttcagatccagcgttttcgccagcgctacaatggctgaaacgatggtcgcatcatcgccgtcaccgttaagctccttcacaaaagcacgatcaattttgagttcgcaggcgggcagacgtttcagatacaacaggctggagtagccggtaccaaaatcatcaatggacgctttgactccggcatgcgtaagctccgtcagaatacgcacgctctcttccggattgctcatcgccgtggtttcggtgacttcaaggatcagatcctccggcgccacctgatagcgttgcaggcagtccatcacgtgttccaccagtccgggttgctcgaattgcagggtggataaattgaccgccatcgaccatgaggtattccccaagagatgccattcccgcagctgccggcaggcctcatcgatcacccaattgccgataggaatgatcagcccggtcttttcggccagtggaagaaatacgtcaggggttaacagaccgcgcttactatgctgccagcgcagaagcgcttcaaagccgaccaccggtccggtgggggcatggaatttaggctgataaaccagacgtagctcgttacgctccagcgcctgccacaaatcattgaccagttgtaactgcgcctgcgccagcgtattcattgacggctggaaaaaatgatacccgttacgccccatgcgtttagtgtgatacatcgccgcatcggcattgaacatcaactcgcgctcattttcaccatcgtgaggaaaaagagcgataccgacactgagtgtgaccaccatttcatagggatcaagagtaaaaggacgatcaaccgcccgtaccagttcactggcaagcgacgcggcttcgtccggcgcgctgacttcagccagcaatacaaattcatcgccgccaatacgcgccagggtgtactggcctttaagcggatgcttcaggcgttcggtaacggcgatcagcaaccgatcccccacgtcgtgaccataggcatcgttcaccgctttaaagccgtccagatccataaacatcagggcaaaaaagctcccttcacgtctcgccttgcggatcgcctgatccagacggtcttccagcaatacgcggttaggtaaacgggtcaacgtatcatggagcgccagttgcgcaagctcgcggttggcctctgcaagcgataaggcaagcagagaagtgcgcgcctgtagtcgtgcatccagcatcgagaccagcagcgtgatccccagaatggaaagtgcgacaacgctgacaagaaccgccagccagttgccgttaacgccatcatgcatcatcgggtgctgatgcgggaaaatcgccgcccgcatgccggtatagtgcatcccggcaatggccagccccatcagaatggcagcgcccgcgcgcatttgcgcaacctgtgccgcttcatggcgcaaacggaaagtcagccacagggcagcccaggaggcgacaaacgcaatcaccagcgacaggacaacccagcgcatatcccagacgatcgccggtgaaacctgtaacgccgccataccggtatagtgcatggcggagatgcccgcgcccatcaccagcgaacccgggagtaaacgacgctgatgcaggttgggtttgcttaccagccacagcgcaaacagggaggcactaaaggcgatcagcattgacagggcggtcatgccgggggcgtagttcatgtgcatggtgagttccatcgacagcatgccgatgaagtgcatcgcccagatgccgatccccatggagaaactcccgccgataagccacacccatgcggttttgccctggctgctggtcacgcgtcctgccatattaagtgcggtatacgcggcgagaatggccacgacaaaagaaattacaaccaggacatggtcgtattggcttaccagcatgatgtcatcaactcgtttacgctaaggcgtcgtattttgtctacagaacaggcggaaagggcgagacattatcattgtctgcaaagggcgcaaagggatttaaatccatgatattaagaggggataacgacagtttcgcttaaaatcgccgacgatcaattactccagctcggaacagttcaccagctttaacggattaacggagttcatgttgcggcatttatccacttcagtggtgaccagctcaacccagaacattaacagcccgtcaaacaggaaaacggtgacggcaaatacaatcagccagccatatttacgcaacatattgtttgttcactctttcgccgatttggtgctggaaatatacacgaaatcccggctaatgaaagaatgacaagcagggttttttaccgctgtttcaggcaataaaaaaggcgcttccccatgccggtaagcgcctttttaaacaagcaatcaactgattagtatcagttcatgccgtattttttcaatttcttacgcagagtgccacggttgatgcccatcatcagagcagcgcgcgtttggttaccgcgggtgtattgcatcaccatgtccaacaatggctgttcaacttcagccaataccagctcatacagatcactcacatcctgaccattcagttgagcaaaatagttcttcagtgcctgttttaccgagtcacgcagaggtttttgagttacctggtcctgagagttaacggtagaaacggtcagtacgtcagaatttacgcgttgttcgaacatagttctgtcagctctttatttctgtttacgcaaaattttcgaagtatgcctccaacgcctccagctgttcgctggcgtcttcaatggcgttgaatgtgcgccgaaactggtcatctggagcgtgctcctggagataccaggatacgtgtttccgcgcaattcgataaccctttgcctgaccgtaaaagtcgtgcagttcccgaatatgcgcacaaagcaagcgcttcacctctgccagaggcaggggaggaagcagctccccagtgtccagatagtgctggatttcccgaaagatccagggtcttccctgagccgcgcgacctatcatcagagcatcagcccctgtatagtcgagcacagctctggctttaagcgggtcagtaatgtcgccattcgcgataatcggaatggaaactttctgcttaactgcccgaatactgctgtattccgcgtctccgttgaacaaacaggcgcgagtgcgtccatgaatggtcagagcctggataccacaatcttcagccagttgggcaatttctacgcagttacggtgttctggcgcccaacccgtgcgaatcttgagcgtaacaggaacgtccacagccgctaccaccgcagtcaggatagacttcaccagatctggatgctgcaaaagggctgaacctgccagcttgcgattcacctttttagccgggcaacccatattaatatcaataatctgggcaccgctttccacgttgatacgtgcggcttccgccatttcttcaggtacgctaccagcgatctgcactgtacgaatacccggctcatcaatgtgcaccatacgtaagcgtgatttatcactttcccagacctgagggttagatgacatcatctcggatacggtaagtcccgctcccatctcgtagcacaacgtcctgaatggcctgtcagtgatgccagccattggcgctgcgatcaggcgatttctgagctggtggtgtccgattcgcatgagttaagaaatgaccatactgtgactgcaaggcggcgtatattacgcattttttgcacgagatgaaaggccaaactttgaacaatccactgttgcagatcattgaatccgctattcatattggatttatcaataaattatcatgcgaatcattgagttatgttaatagtaataattcatgacgtaactaaaattccttaaatacagtgaattttgccgctaaaaaacggcgggttatctggtaacttgctgtttttatagacacttcaactccagtaatgcgatctacctctcgtttttttctgctcataaaagcatcgttacgcggtacgggttcacgcaatagtgtgtcgttattcgatgatcacccgaccgtgtcccggctgtacgggacgattattttcatgaggtaaaacgcgggtcagcgtcttcagttgttcctctgaaagcgaaagcggctctttcataaccagccagcgcacgccttccgtacagggcggcgtggtgagcgatccgctatagcgatagtacgttgtgcgtgcaggcagcagttttttgatgtcgacatcctgagtaagcgccacgctctcgtccgcctcgcgcggcatttcataccacagcttctggagttcattgtttggcttcccggtggtaaacatgacggccacgaccgccgtctcaccttgcgcgttctggtgcaccagatgcatctccagcgggtaatgcttaccaccaaccgtattttccgacggcgcatggaaatgcagttgccggagcaggaacagctcgccgtctattttcacgctgtttttgttaccgtcggcaaagttggccatcaccgtaaagccttcatggctgaggcttatcgggctttgcggataacgtggttttagcggcataagacgggttttcatgaccgctgtaatatcgacaggcgactggttcatccctttgctgcacataaaatagtccggattcagttctccccagtacgccggggcgctttctccttcataactccattcgtttgcggtggcgcaggtcgacagcagacccagcgctaataaagtcacgccgcgtaatccggtgctcataatattcatcctatgaatagttaatcccaaaaaagatattaattttcaatgaattgaaaggaaaattataagcttattggcggctgaataaacgacaaaaaatggggcaggcaggagaaaagcgcaacgcagcagaaaactgcgttgcggcagggacttattttttacgaccggtaatgcggcaccactcttctttttccacgacgggatcaagcgagaacagatcggcataggcatcacaaacgctttccgcctggctggccagaataccggaaaggcccagcagaccgccttcaacaggcagtacgctgatcagcggcgccagttcacgcagcgggccggcgaggatattcgccaccaccacatcggctttcatggtcgctggctggtcctgcggcaggtacagctccagacgatcggccacgccattacgttcggcgttatcacggctggcctgaatggcctgcggatcgatgtcgataccaatggctttcgccgcgcccagtttcagcgccgcaatggcgaggatgccggagccgcaaccaaaatcgatcaccgttttaccggtcagatccaggccatccagccattgcagacacagcgaggtcgtagggtgagtgccggtaccaaaagccaggcccggatccagcatcacattgacggcgttcacgtccgggacatcgcgccagctcgggcagatccacaggcgctcaccgaaacgcatcgggtggaagttttccatccactcgcgttcccagtctttatcttccagctgttcaattttgtgcgcaaaacccgcgcccagcagcggatgcaacgcaagcagtgataccacctcgttcatgtccgtttcggcatcaaacaggccgatgacgtccgtgtcaccccacaggcgggtttcgcccggcagcggctcaaacaccggcgtatcgtgcgtgtcctggaaggtgatagagacggcgccagcttcgagcagcgcatcgctcagcgcttcggcattcgccccggttgtattcagtttcagttggatccacggcatggcaaaactctttatttatcagatgtaataacgtgaccttccgcaaccgggcgaccaaacaggttcccgatcagaaacgccagcaaactcagtaacagcgacggaacaatcgggtggaagcccagatattgtattttaaacgtcgccagcacggcatagagcacaccgcccacaatcatcgcgctaagcgccccggccgcattggcccgctcccagtagaggcccagcaccagcggccacaggaatacggcttccagcccgccaaaggccagcaggttaagccagatgatcatctctggtggacgccaggccgccagcaacagcaagacgccaaggatcagcgtgatcgccgaggacattttcttcagccgcttttcattattgatctgcgccggatagagattcaggtagagatctttaatgatcgtagcggaactttgcagcaactgtgcgttgatcgtcgacatgatcgccgccattggtgccgcaaggaagatccccgccgcaaagggcggcaacactttcatcatcagcgttgggatcaccaggtccggcacgatcagatcggggatcaccgcccggcccagtgcgcccgccagatgcatgcccagcatcaggatcgccaccacaatggtgccgatgatcataccgcgatgcaccgctttgctgtctttataggaaatgcagcgcaccgccgtatgcggcaggccgatcaccccaaagcataccagcacccaaaacgaggtcataaaggtaggggtgagaatatcctcagcgccatgaggggacaccagtttcggatcgaggcgttgcagcgtatcgacggcgttacccagtccgccagcggcatgcaccacgccgaccagtagcacgatagtgccaatcagcatcaccatgccctggagggtatcgttgagcacgctggcgcggaaaccgccgtaggcggtatagagcgcaatgctgacgccaaaaatcagcagcccggtttcgtaaggaataccggccgccgtttccagcagacgcgcgccgccgataaactgcaccgccatcgcgcccacaaaggcgaccagcaggctgatactggccagccataccagcaggcggctctgatagcggccaaacagcatatcgttgagcgtcacggcgttataacgacgcgcgaggatcgcgaattttttgcccagaatacccagcgacagccagacggcaggcaactggatcatcgccagcagcacccagccgagaccatatttgtaagccgcccccggcccgccaataaatgaactggcgctaatgtaggtggcggtcagcgtcattgccagcacgatcccgcccatggagcggctgccgagaaaatactcgttaaggaatgagccggcggcgcgcttgcgcatggcatagaccgacaggccaaaaaccaccagcaaataggcgaccagtggcagaatgacttcaagctgcatcgtcgtcctccagggaaatatcccggtagataaatttcaccatcgcccagcacagcaggataaataccagcggcagcagcagacaggacatttcaaaccagtgtggcagtccggtgaacccggtcatatctcccggtaagtaagcggtcactaaccaggcggcgagataaagcagcgtaagccagagcgcccagcgggcctctttgtgcgcctgaacgaaacgtgtatccattatcgtccctcggggatcagaaaggcggggattgtaccgcaagagcgaaaaagagaataaaaaaaaggccggaaatccggccttttgctgcgagcgcttaattacttctcatgaagaccgagcttcttctccagatagtggatgttggtgccaccgtgctggaagttctcgtcattcatgatgcgggtttgcagatcaacgttggttttaatgccgtcgatgattagctcctgcaacgcatttttcatgcgggcaatggccacgtcgcgggtttcaccgaagcagatcagcttaccgatcatggagtcataatacggcggtacggtataaccggcgtaaatatgcgattcccagcgcacgccaaaaccgcctggcgcatggaaacgggtgattttgcccgggcttggcaggaaggtgttcggatcttcggcgttaatacggcactcgaccgcatgaccctgaaccctgacgtcttcctgtttgatggacagcggctgacctgcggcaatgcgcagctgctctttgatcagatccacaccggtgatcatctctgttaccggatgttcaacctgaatacgggtgttcatctcaatgaagtagaactcgccgttttcgaacaggaactcgaaagtacccgcgccacggtagccaatgtcaatacaggctttggagcagcgttcgccgatgaatttacgcagttccggggtaatgcccggcgctggcgcttcttcaacgactttctggtggcgacgctgcatggagcagtcacgctcggccagataaatggcgttaccctgaccatctgccagcacctgaatttcgatgtggcgagggttttccaggtatttttccatgtacaccatgtcgttgctgaatgccgctttcgcttcagctttggtcatggagatggattgcgccagttcggcatcaccgcgtaccacgcgcataccgcgaccgccgccgccgccggacgccttgatgatcaccgggtagccaatgcgtttagcatgggcacggttagcatccatatcgtcgccgagcgggccgtcagagcctggtacggtcggcacgcctgctttcttcatcgcggtgatcgccgacactttgtcgcccatcagacgaatagtgtcagctttcgggccgataaagataaagccagagcgctcaacctgctcagcaaagttggcattctctgaaaggaagccataacccgggtgaatcgctgccgcgccggtgatttcagccgcgctgatgatcgccggaatattcaggtagctttttacggacggtgccggaccgatacagaccgtttcgtccgccagtaatacgtgttttaaatcgcgatccgctgttgagtgcacggcgacagtcttgatgcccagttctttacaggcacgcagaatacgcagagcaatctcgccgcggttggcaatgacaattttatccagcatgttcgcctcgttattcgatgacgaccagaggctcgtcaaattctaccggttggccgctttctaccagaatggctttcaccacgccggatttgtcagcttcgatctggttcatcattttcatggcttcaacgatgcacagggtgtcgcccgcattcactttctggcccacttcgatgaacgcttttgcgtccgggcttggggtgcggtagaacgtcccgaccatcggggaacgtacgatgtggccactgatttctgctgctgccggcgcttccattgttggggtggcggcaggtgcaacagcgttagccagggctggctgttgcatcatcggtgcggcataagcctgctgcatcatgggataacccacgtttggcgcagcacggctgatacgaacagactcttcgccttcagaaatttccagttcggagatgcctgattcttcaaccagctcgatcagttttttaatcttacgaatatccatgagtgggttccgtactcttgtttagtgtgattgtgacaggcgttttaccgccgtctgtaaagcgtatgaataaccgtcagcgccaaatccgcagatgacgccagcagcgatatcggagagataggagtgatggcggaacggctcacgcgcatgcacgttgctcaggtggatctcgataaacgggatactcacggcgagcagggcatcacgcagggcaacgctggtgtgcgtaaacgcggccggattgatcaggatatagtcgacattgtctttagcctgatgaatgcggtcgatgagtgcatactccgcgttggactgtaaatgcgaaagagacacgttgagcgcttcggcttcctggcttaaagaagtaacaatttcgttaagcgtcagggtaccgtacttctccggctcgcgcgttcccagcatattcagattagggccgtttaagagcaaaatgtgcaacttgtccaccattgtgctgctatctcctgcaatacttcggtaaaaaacaaaatataccttcattgcccggttgtcaccttttcagagtcctaaaaaccctgtcggcaaaaccaaagtcgcacattataacgatttcgtagcatttggcagctaaatactggtcttatcagggaagattatcaaccgctatccaggaaatgacagcggatgacagaagaactgcgggaaagtgcacagaaccgtgcactattgccaccattgacggaacttcttgtaacgccacgccaaaagcaccagcgcggctaccgcatagagtaccggctgcggggataataccttcaccgaccacagataatgaatgggcgcgaggatcgccacaagataaacgaaattgtgcagacgttgccagtttctgcccaattttcgcatcatggcctgtgtggaggtcagcgccatcgccagcaggatcagccagctgataccgccgagcgtcagataaggacgggatatcagctcctggcccagcagaccaagattattaatccccagctccagcatgacgtaactcaccagatgcagactggcccaggtaaaacaccaaagccccagcaggcggcgggtgcggatcagcaacggttgtctggcgtaacgcgccagcggcgttaccagcagcgagccgagcagaaactttaacgccatcctgccggtaaaatgctgaatatctttcgccggatcggcgctgaaccagccctggctcgccgcccagaacagccagagcagcggcaacagtccggcaagatgcagtacacatttcagccccgtcacctgtttcgccgtcagacgcatttaaaaattctcccgcaaatccatgcccttatagagcgacgcgacttcatcggcatagccattaaacagcagcgtcggctgacgattcacgtccagcacgccgccggaaccaataaagcgttcagtggcctgcgaccagcgcggatgatcgacatgcgggttcacattggcaaaaaagccatattcattgggtgccgaaagattccaggtagtgggaggacgctcacgggtcagtttgatgctgacaatggatttaatgcctttaaagccatatttccatggcacggtcagacgtaccggcgcaccgttttgcggcggcagcgctttaccgtacacgccgacggttaacagggtcagcggatgcatggcttcatcaatacgcagcccttcaacatagggatatttcaggccgccgccgataaagcgatctttctggccgggcatctcgtccggggaatataaagtttcaaacgccacgtattttgcgttgctggtgggctccaccagcgcgagtagcttatgcagcgggaagccgatccacggcaccaccatcgaccaggcctccacgcagcgcatgcggtaaattcgctcctcaagggggaagcgcgtggtcagcgcatcgtgatcgagggtcagcggctttgccacttcgccgctgatggtgagcgtccagggatcggttttcatgctgccggcgttagccgccggatcggccttatcgagaccaaattcgtaaaaattgttgtaacccgtgactttttcttcaggcgtcagagaaagtttactctgccattcatcaggtttattaaagttcagcggtttcccggcgggggcttttggccggtcattgcccttaaaccagctgagcagatcggcctgcgccgcagaggaaagagaaagggcggtagcgctgatgcccagcgtttttaatacctgacgccgttgcagcataaataccgattctgccgtgacatctgcttctgttagttttcgtggtttcatctcatcctccgtctgctttatataagcatgacggatgagttgcgccagcgcgagtgtgttaccaaaatttgcctgctcacttttgtttgatagtatcccgtttcctgctgcaagttagcgcttactctacactatgtcatgacggcacaaagcgcccttcaaccaacggagttaactcagggatgcgattaacgacgaaattttcagcctttgtcactctgcttaccgggctggcaatatttgtcaccctgctaggttgttccttcagcttttactctgccattcagaacaaactcagcaaccgggtgcagtcggtggccgccattattgatagccgtctcgtctcaacgccggtaaatgttctcagcgcccaacttaatgaaatcatggtgccggtggatattgcgcgcatcgttatccggcagggcgatcatacgctggtcaatcagaccgccaaagatgtctatcgtccgcagggcagcaccacgcaataccgtgaaatcaccatccattcgctgaaaaatccaggtacgaccatttcaatgacttaccaggatccgatggtgaactattttcattccctgctggcgaccgcgcccttaaccctcgccatcggttttatggtgatcattatttttctggcggtgcgctggctacgccgccagctcgccggacaggagctgctggaaaaccgctcagtaaaaatcctcaacggggagcgcgggccgcaggtgcgcggaaacgtgcatgaatggccgtcgcgcaccagcagcgcgctggatgtgctgctgacggagatccagacggcggcggatcagcgcagccatatggataccctgatccgcgcgtacgttgcccaggacaccaaaaccgggctcagcaaccggttgttctttgataaccagctggcaacgctgctggacgatcaggaaaacgtcgggacgcacggcgtggtcatgctgatccgcctgccggattttgattcactgcgcgataaatggggcgcagccgccaccgaagacaacctgtttgtgctcattaatttgctttccacctttatgctgcgctatcccggcgcgctgctggcccgctatcagcgcaatgactttgccgtattactctcgcaccgcacgctgaaagagtcagaaagtatcgccgcccagttgctgaaatcggtggacgcgctgccgccgtcaaaaatgctcgaccgggatgacatgatccacattggcatttgcgcctggcgcggcgggcaatccaccgaacaggtgatggaacacgctgaagcggccacgcgtaacgccgtattgcagggcggcaacagctgggcggtgtgggatgatacgctgccggaaaaagggcgcggcaatgtccgctggcgaacgctgatcgaacagatgctcagccgcggcggcccgcgcttttaccagaaacccgcggtaacccgcgacgggcgcgtgcatcaccgggagctgatgtgccgcatttttgatggcgatcaggaggtcattccggcggaatatatgccgatggtgttgcagttcggactggcggaggagtatgaccgtcagcagatcacccggttgatccctttcctgcgtttctggccggaagagagcctggcgatgcccatcacggtggaggcgctgatccgcccccagttccagcgctggttgcgcgataccctgatgcaatgtgaaaaatcacaacgtaaacggattattattgaacttgcagaggcagatgtttgtcaacacatcagccgtttacaacctgtcgtgcgattaatgaccgcattaggcgcgcgaatagtggtcgctcaggcgggtttgacgctggtcagcaccagctggatcaaggcgctggatgtggaactgctgaagctccatccgagcctggtgcgtaacattgagaagcgcaccgaaaaccagttgttggtacagagtctggtggaggcctgcaaaggaacgcaaacgcgcgttttcgccaccggcatccgtactaaaggggaatggcagaccctgattgaacgcggagtggcaggcggacagggggatttttttgcagcctcgatgccgcttgacaccgaagtaaaaaaatattcacaaagatactctgtttgacctgccgtttaacgttatttcacgtagaataacgcgcgctgtatcttgtgggggtgtgcatgtctgcccgccagttcgtgcagtaaaaaagccagtgaatgaccttagactggttgcaaagtgatagcgaggaacgctgcggtctctatctgtcctgaaggagtcaggtcgatttgtaactcaaggacacaaactgcactaattttcaccgtagccgtcgatttttgcgccttgtcgctgctgcgtgtggttggtaaagtaagcggattttattcttccgccccagctttcaggattatccctcagtatgttgaaaaaatttcgtggcatgttttccaatgacttgtccattgacctgggtaccgcgaatacccttatttatgtaaaaggacaaggcatcgtattgaatgagccttctgttgtggctattcgtcaggatcgtgctggttccccgaaaagcgtcgctgcggtaggtcatgaagctaaacagatgcttggccgtacgccaggaaacattgcggctattcgcccgatgaaagacggcgttatcgctgacttcttcgtgacggaaaaaatgctgcagcactttatcaaacaggtgcacagcaacagctttatgcgtccaagcccgcgcgtgctggtgtgtgtgccggttggcgcaacccaggttgagcgtcgtgctatccgcgaatccgcgcaaggcgcaggcgcccgtgaagtctttctgattgaagagccgatggctgccgcaattggtgcaggcctgccggtttcagaagcgacgggttccatggtggtggatattggtggcggtaccacagaggtggccgttatctccctgaacggcgtggtctactcctcttctgtgcgtatcggcggcgaccgcttcgatgaagccatcattaattatgtgcgtcgtaactacggctcgctgattggtgaagcaacggccgagcgtatcaaacatgaaatcggttctgcttacccgggtgacgaagtgcgcgaaatcgaagtgcgcggtcgtaacctggcggaaggcgtgccgcgcggctttaccctgaactctaacgaaatcctcgaagcgctgcaggaaccgctgacgggtatcgtcagcgcggtcatggttgcgctggaacagtgtccgccggaactggcttctgacatctccgagcgcggtatggtattgaccggtggtggcgcgttgctgcgtaaccttgaccgcctgttaatggaagagacaggtattcctgtcgtagttgcagaagatccactgacctgcgtcgcgcgtggcggcggcaaggcgctggaaatgatcgacatgcacggcggcgatttgttcagcgaagaatagtcggtgtcagatccggggcggcgctattgccgcttcggttctggccggcctgagaatacgcatagcctatgaagccaatttttagccgtggcccgtcgctacagattcgccttattctggcggtgctggttgcgcttggtgtcattatcgccgacagccgcctgggtgcgttcagtcagatccgaacgtacatggataccgccgtcagtcctttctactttgtctctaacggtccccgtgccctgctcgacagcgtatcgcaaacgctggcatcacgtgaccagctcgaacttgaaaaccgggcgctgcgccaggaactgctgctgaaaaacagcgaactgctgatgctggggcagtacaaacaggagaacgcgcgtctgcgcgagctgctgggctcacccctgcgccaggatgaacaaaaaatggtgactcaggtcatctcgacggtgaacgacccttacagcgatcaggtggttatcgataaaggcagcgtgaacggcgtctacgaaggccagccggtgatcagcgataaaggcgtggtcggccaggtggtggcggtggcaaaacttaccagccgcgtgctgttgatctgcgatgccacccatgcgctgcctatccaggtcttacgtaacgatattcgcgtcatcgcggctggtaacggttgtaccgacgacctgcaactggaacacctgcccgccaacactgacattcgtgtcggcgacgtgctggtgacatccggtctgggcggacgtttcccggaaggttatccggtgggcgtcgtctcctccgttaagctggatacgcaacgtgcttacaccgtgatccaggcgcgtccgacggcgggtttacagcgtttacgctatttgctgctgctgtggggcgcggatcgtaacggggcaaacccgatgacgccggaagacgtgcaccgcgtcgcgaacgaacgtctgatgcagatgatgccccaggtattgcctgcccctgattcgatggggccgcctgcgcccgtgcctgcaccggcaaccgggttgccgcagtctgccggtacagcgccgggaggacaatagtgggcagttatcgtagccagggacgctgggtgatctggctctcgtttctcattgcgcttttattgcagattatgccctggccggatgacatcattgtctaccggcctaactgggtactgctaatcctgctctactggatcctcgctttaccgcaccgtgtgaatgtcggtacaggtttagccgtgggtgccatactggatctcatcagcggttcgacgcttggcgtgcgggccctgtcactgagcattatcgcttacctcgtggcgctcaaattccagcttttccgtaacctcgcgctctggcagcaggcgctggtggtgatgctgctttcgcttgccaccgaggttattgtgttctgggcggaattcctggtgatcaacgtctccttcaggccggaagtgttctggagcagcgcggttaacggtgttctctggccatggcttttcctgctgatgcgcaaaatacgccagcagtttgcggtgcaataaaagggtgttatgacagatctctatcttgcttccggctctccccgccgtcaggaattgctcacgcaactgggcgtctcatttgaacgtattctgcccggcaccgaagagtgccgtcaggcgcaggaaagcgcgcagcaatatgtgacgcgtctggcacgggaaaaagcccaggctggcgtggcgcaggcagcgcgggatttgccagtgctcggcgctgacaccattgtcattttaaatggcgaagtgctggaaaaaccgcaggatacctctcatgctgctaagatgttgcatcagctttcagggcaaacgcaccaggtgatgactgccgtagcgctggccgatcgtcagcacattcttgactgtctggtagtcacagatgtgacattcagagtactctctgatgatgagatcatggcgtacatcgccagcggcgaaccgatggataaagcgggcggctacgggatccagggactgggcggctgctttgtgcgacggattaacggcagttaccacgctgtggtcggcttaccgctggtagaaacctatgagttgctgagcaattttaacgcactgcgcgagggaaggaataaagatgacggctgaattgttggtaaacgtaacgccttcagaaacacgcgtggcgtacattgatggcggcattttgcaggaaatccacattgagcgtgaagcgcggcgcggaatagtcggcaatatctacaaaggtcgtgtgagccgtgtgctgcccggtatgcaggcggcttttgtagatattggtctcgataaggcggcgtttctacacgcctccgatatcatgccgcataccgaatgcgtggccggggaagagcagaaaaacttcaccgtgcgcgacatttcagagctggtgcgtcaggggcaggatctgatggtgcaggtggtgaaagatcccctcggcaccaaaggcgcgcgtctgacaaccgacatcaccctgccatcccgttacctggtgtttatgccgggcgcgtcccacgttggggtatcccagcgtattgaaagcgaaaccgagcgcgagcgtttaaagcgcgtagtggcggaatattgcgatgagcagggcggttttatcatccgtaccgccgcagaaggcgtatgcgaagaagacctggcctccgatgccgcctaccttaaacgcgtatggacgaaagtcatggagcgcaaaaagcgcccgcagacgcgttaccagatgtatggcgaactggcgctggcccagcgcgtgctgcgcgatttcgccgacgcgcacctcgatcgtatccgcgtcgactcccgcctgaccttcgaagcgttgctggaattcaccgccgaatatattccggagatgaccagcaagcttgagcattacagcggacgccagccgattttcgatctctttgacgtcgaaaacgaaattcagcgcgcgctggagcgcaaggttgaactgaagtccggcggctatctgatcatcgatcaaacggaagcgatgaccaccgtcgatatcaataccggggcctttgtcggccaccgtaatcttgacgacaccatttttaacaccaacaccgaagccacccaggctatcgcccgtcagctgcggctgcgcaacctcggcggcattattattatcgatttcatcgacatgaataatgaagatcaccgccgtcgcgtgctgcattcgctggagcaggcgctcagcaaggatcgcgtaaaaaccagcatcaacggtttctcacagctcggcctggtcgagatgacccgcaaacgcacccgcgaaagcgtcgagcatgtgctgtgcaacgaatgcccgacctgccatggtcgcgggacggtgaaaaccgtcgaaaccgtctgctatgaaatcatgcgcgaaattgtccgtgtgcatcatgcctacgattccgatcgtttcctggtctatgcttctccggcggtggccgaggcgctgaaaagcgaagagtcccacgcactggcggaagtcgaaatttttgtcggcaaacaggtcaaagtgcagattgaaccgctctacaatcaagagcagttcgacgtagtgatgatgtaattcgtagcatgctgcgacacgatcaaggcctgttgcgcgggctgacaaggagagatgcgtgaggcgactgccggggatattgctgctgactgtggcgacattggttgtcatcattgcgctgctggtgagcggcctgcgcctgatgctgccgcatctggacagctggcgtccggccatcctcgcgaaaatcgaatcctcctccggcgtgccggtagacgcaaaacaggttaccgccagctggcaaaacttcggcccgacgctggacgtacgcggcatccacgccggttttaaagacggcggcgaggtgtccattgagcgcgtcaccctggcgctcgacgtctggcaaagcctgctgcacctgcgctggcagttccgcgatctcaccttttatcagcttcaggttcataccaatacgcccctgcaacagagcaatgacagcgagggcatggaaaccagccgtctgagcgatctgttcctccgccagttcgaccatttcgatctgcgcgacagccatatcagtttcctgacgccatccggacagcgggccgagctggcggtgccacagctgacgtggcttaacggcaaagcccgtcaccgtgccgaaggcgaagtcagcctctccagccttaccggacaacacggcgtgatgaaagtgcgtatggatctgcgtgacgacgaagggctgctcaaccatggccgcgtatggctacaggccgatgatattgacgtcaaaccctggcttggcaaatggatgcaggataacgtcgccctgcaaaccgcgcgctttagccttgagggctggctgacgctgagcaaaggcgaagtgtcggggggcgatgtctggctgaaaaaaggcggcgccagctggaaaggcgatagccagccgcaccgtttgtcagttgataatctgacggcgcacgtcacccgccagcagcagggctggcagttcgatattcccgaaacccgtatcaccatggatgacaagccgtggccgaaaggcgcgctgtcgctggcctgggttccggcgcaggaagtgggcggggcgaagggcgtacgcagcgacgaactgcgcgtgcgcgccagccatctggaactgaacgggctggacggcctgctgcccattgccgaaaaactctcgcctgcgctgggcgaaatctggcgcgccatgcagccgaccgggcaaatcgaaaagctggcgctggatattccccttcaggcgactgaaaaaacccgctttcaggcgaactggaacaatcttgcctggcagcaatggaaaatgctgccgggcgtcgagcactttaccggtacgctctccggcagcgtggacgacggcaggctgaccggcagcgtcaccgatgcgaaaatgccctacaaaacggtattccgcgcgccgctggaaatcgaaaagggcgtcgccacacttaactggctgaaaaatgacaaaggtttccagctcgatggtcggcagattgatgtcaaaggcacgggcgttcatgcgcgcggcgattttcgttatctgcaacctgccggagatgaaccctggcttggcattctcgccgggatcagcaccgatgatgccggacaggcctggcggtacttcccggaaaacctgatgggtaaagcgctggtggattacctgagcggcgcaatccagggcggccaggtggataacgccaccctggtgtacggcggtaatccgcatctgttcccctataaacataacgaaggccagttcgaagtgctggtgccgctgcgtaacgccaccttcgcgttccagcctggctggccggcgcttaaaaatctcgatatggaactggacttccttaatgacggcctgtggatgaggaccgatgaggtcaaccttggcggtgtgaaaggtcataatctgacggcggtgatcccggattacctgaaagaaaaactgctgatcgatgctgatatcagcgggccaggcaaagcagtggggccctatttcaacgacacgccgctgaaagattcgctgggcgccacgctggaagagcttcagcttgatggcgatgtaagcgctcgcttacacctcgatattccgctggatggcgaaatgacgaccgccaaaggcgacgtgcgcctgaataataacagcctgtttattaagccgctgaacagcacgctgcataatttaagcggccagttcagctttgagaacggcaatctgaaaagcgagccgctgaccgcccgctggtttaatcagccgcttaacgtgaatttctccaccaccgagggcgaaaaggcctatcaggtggcggtagatctgaacggtaactggcagcctgcgggcatagaggcgctgccgaaacagctgcgcgatgccgtcagcggtagcgccgcctggaatggcaaagtgggcatcgagctgccttatcatgccggtgcgcgctacaacgtggatatcaaaggcgacttaaaaaatatcgccagccgtctgccttcgccgctggaaaaagccgccggtcagccgttgccgttaacggtgaaagtggaaggcgacctgcggcgtttcgatctgacgggcaaagcgggcagcgacagccatttcaacagccgctggctgctgggtaaaaagctgaccctggaccgcgctatctggacgtcggaaagccggacgctgccgccgctgccggaaaccgcaggcgtggagctgaatctgccgccgctggatggcgcgcagtggatggcgttgctccagcagggcgtggcgaataacgtcagtagcgcgacggccttcccggaaagcattaccctgcgtaccccggcgctgacgctcggcgggcagcaatggaacaacctgagcatcgtgaagcagccggtagcgggcggtgctaaagtcgaagcccagggacgtgaaatcaatgctactgtcacgatgctggataacgctccctggcaggcggcgatccgctatctctattacaacccggcggcggccgagcgcgatccgctgtcgccgacgacgctgcttaccaaacggcagatcgatttcagcggctggcctgatctgcaattacgctgcgcggagtgctggttctggggacaaaaatacgggcggctcgacggcgatttcacgatcaatggcgacaccttaaccctgaagaatggtctgctggacagcggctttgcccgtctgacggcgaacggcgaatgggtcaaccgcgccggtgccgaacgcacgtcgattaagggcagactgaagggggataagatcgacgcggcgaccaatttctttggtgttaccacgccactgcgggaagcgccttttgacgtcgattacgatttgcactggcgtaatacgccctggcagccggaagaggcctccctcaatggtattctgcgcacccggctgggtaacggcgagatcgcggatgtcagcaccggacgcgccgggcagctgctgcgcctggtaagtttcgacgcgctgctgcgcaagctgcggtttgatttcagcgacaccttcagcgaaggattctactttgactccatccgcagcaccgcctggatcaaagatggcgtgctgcataccgatgacaccctggtggatggcctggaagcggatatcgccatgaaaggatcggtagacctggttcgccgtaaactcgacgtggaagccgtggtggcgccggaaatctccgctaccgtcggcgtggcggccgcttttgcggttaaccccatcgtcggcgcagcggtattcgccgccagtaaagtgctggggcccttgtggaataaagtctccatcctgcgctaccagatcaccggcaccatggataaaccacaaattaatgaagtgctgcgccagccgcgtagcccggcgaagcaatgatttgacgggggcgagtaattgcctcactctcaatagatatgatttctaccgctaacctggcggcaaccaaagagtagcaacatgacgagtttgaatctggttagtgaacaattgctaacggcgaatggcctgaatcatcaggatctgttttccattcttggccagctggccgagcgccgtcttgattacggcgatctctatttccagtcgagctatcacgagtcctgggttttagaagacaacatcattaaagacggctcgtatcacatcgaccagggcgtcggcgtgcgggcggtaagcggtgaaaaaacgggctttgcttacgccgatcagatcagcctgctggcgctggaacagagcgcgcaggcggcacgcactatcgtgcgcgacagcggcgacggtaaagtgaaaaccctgggcgcggtggagtatggcgcgctctataccagcgtcgatccgctgcaaagcatgacccgcgaagagaagctagacattctgcgccgcgtgaatgcggtggcccgtgccgcagataagcgcgtacaggaagtgaatgccagcctcaccggtgtttatgaactgatcctggtggccgcgactgacggcacgctggcggcggatgtccgtccgctggttcgtctgtcggtcagcgtgcaggtggaagatcagggcaagcgcgagcgtggctcaagcggcggcggcggtcgtttcggctatgaatggttcctcgccgatgcgggcggtgaagtccgtgcggatgcgtgggcgaaagaagctgtgcgtatggcgctggttaatctctccgccgtggcggcccctgccggtacgctgccggtggtgctgggcgcgggctggccgggcgtgctgctgcacgaagcggtcggtcacggtctggaaggggacttcaaccgtcgcggcacctccgtgttcagcggacagatgggccagctggtggcctccgaactctgtaccatcgttgatgacggcacgatgcacgatcgtcgcggctcggtagcaattgatgatgaaggtacgccaggccagtacaacgtgctgatcgagaaaggcgtgctgaaaggctatatgcaggacaagctgaacgcccgtctgatgggcgtcgcgccaaccggtaacggccgccgcgaatcctatgcccatttaccgatgccgcgcatgaccaatacctacatgctggcggggcaatccacgccgcaggagattattgaatccgtcgaatacggcatctacgcgccaaactttggcggcggtcaggtggatatcacctccggtaaattcgttttctcaacgtccgaagcttatctgattgaaaacggtaaagtgacgacgccggtgaaaggcgccacgctgatcggctccggtatcgaagccatgcagcaggtgtcgatggtcggtaacgatctgcaactcgacagcggcgtgggcgtatgcggtaaagaagggcagagcctgccggtcggtgtgggtcagccgacgctgaaagtggataacctgaccgtaggcggtacggcgtaatttattgcgtgaaattgcccggcggcgctgcgcttgccgggcctacatcatttctctttcgcccgtccgcgcatcgcctgaaacaggttcgccacctcaacaaaataatccgtcagatagttaatacacacctgcaccttgagcggcagcttgtccttttcggtataaagggcgtaaaccgggcgtggatctgactggtagcgcggaaataagatctccagcgtgccgcggttgatctcatcgatcacccacatcagcggcacataggccactccggccccggcggtcagccagcgggttagcgtcatcggatcgttagtgacaaaacggccctgcgggatcaggcgcgtggatagcccttcaggggcgatcagctcgaattcgttatccgggcgcacgctgtactccagccaggagtgattgctcagatcggcgggtttttcaggaatgccgtactgcgccagatagcttttcgcggcgcacaccaccatcggcatcgcccccagacggcgggaaaaaaggctcgaatcctgcaatgcccccacgcggatcaccacgtccagcccgtcggcaataagatcgggggcggggatccccgtcaccagattcaccgtcaggccggggtaatccttcagcatccgggcagtcatcccggcgaggacattttgcgccatggttgaagaacagccgatgcgcagcgtaccgatgggcgtgttattaaaagcgtagagctgttcatgcacgtcctgtacttcatgcagcatccgtcggcagccctgataataaattttaccggcttcggtcagcgccaggctgcgggtgctgcggttaagcaacttcacttgcaactcatcttccagcttcgagacggtctggctgatagaggagacgctcatatgcagctgtcgcgcggcagcggtgaacgaacccagttcgacgacgcgggcaaacaccgacatgcgttttaatcgttccattgttcactctggcttaaaagtgatttagatcacactatatagatgacagcataacagttacgctaatatatagttagctgaataatagatacgtcactctcgcctggcctttctggccctaatccctgcggtgacgtgaataataattgtctcctgcatgcgttaatcaaggtcaacatgagtctgtttcccgtggtcgtggtgttcggtctgtcgttcccaccgatattctttgagttacttatatcactggcgctgttctggctggtgcgccgtctgctgctcccgacaggtatctatgactttgtctggcacccggcattgtttaatacagcgctatattgctgcttattttatttactgacgcgcctgttcgactgaggtagatgtgaaaacactaacaagaaattttacccgtaccgccatcaccgtggtgatggttattctggcattcatcgccatctttcgcgcatgggtctattacaccgaatcgccatggacgcgtgacgcgcgttttagtgccgatgtggtcgccatcgcgccggatgtcgcggggctgatcaccgatgtgaaggttcacgataaccagctggtgcagaaagaccaggtgctgttcaccatcgaccggccgcgctatcaaaaagccgtcgaagaagccgaggctgacgtggcgtactaccgcgcgctggcaagtgaaaaacgccgcgaagccggacgtcgtaataaattaggcatccaggcgatgtcccgcgaggagatcgagcagtccaacaacgtcttgcagacggtgatccaccagcaggcgaaagcgcaggcgacgctggatctggcaaaactcgatctcgaacgtaccgttatccgcgccccggccgcaggctgggtgaccaacctgaacgtctataccggggaatttataacccgcggttcgacggcggtggcgctggtcaaacaaaattcattttatgtactcgcctatatggaagagaccaagctggaaggtgtgcgaaccggctatcgcgccgaaattacgccgctgggcagtaaccgggtgcttaaaggcacggtagacagcgtcgccgccggggtcaccaacgccagcagcagccgtgacgccaaaggcatggcgaccattgactccaatcttgaatgggtccgcctggcgcaacgcgtgccggtgcgtattcgcctggacaatcagaaagagaatgtctggcccgccgggaccacggccacggtggtgatcaccggtgaaaaagaccgggacgaaagccaggactccttcttccgtaaactggctcatcgtctgcgtgagtttggttaagcatgatgggcattttttccatcgccacacagcacattcgcttcgccctgaaactggcgtgcgccattgtgctggcgctgttcgtcggctttcacttccagcttgaaaccccacgctgggcagtgctgacggcggcgatcgttgccgcaggcccggcgtttgcggcggggggagaaccttactccggggcgatccgttaccgcggcatgctgcgtattatcggcacctttatcggctgcgtggcggcgctgaccatcattattctgatgatccgcgcgccgctgctgatgctggtggtttgctgtatctgggccggattttgtacctgggtctcctcgctggtgcgtgtcgaaaactcctacgcctggggactggcgggttatacggcgctgatcatcgtcatcaccattcagtacgagccattactcacgccgcagtttgcggtggagcgatgcagtgagatcgtactggggatcgtttgtgccatcgtcgccgatttgctgttttcaccccgctccatcaaacaggagatcgaccgcgaactcgacagcctgctggtggcgcaataccagctgatgcagttatgcatcgcgcatggcagcggcgaagagatggataaagcctggggcgcgctggtgcgccgtaccacggcgctggaagggatgcgcagcaacctgaatatggaatcctcccgctgggcgcgggcgaaccggcggctgaaagtgattaacaccctgtcgctgacgctgatcactcaggcctgtgaaacctggcttattcagaacacccgaccggaagcggtgaccgacaccttccgcgaactctttgcggagccggtagaaaccgcgcaggacgtacataaacagctcaagcgcatacgccgggtgattatctggaccggcgaacgcgacacgccggtgacgatttacagctgggtcggggcggcaacgcgctatctgctgctcaggcgcggggtgatcggcaacaccaaaatcagcgccacggaagaagaggtgctggaaggcgaaactgtggttaaagccgggtccgccgagcgccatcatgcgatggtgaacttctggcgcaccacgctctcctgtattctcggcacgctgttctggctgtggacgggctggacctcgggtaacggcgcgatggtgatgatcgcggtggtgacctcgctggcgatgcgcctgcctaacccgcgcatggtggcgattgattttgtgtacggtacgctggcggccttacccctgggggcgttctacttcttggtggtgatcccctccacgcagcaaagcatgctgttgctgtgcatcagccttgcggtgctggccttctttatcggcattgaagtgcagaaacggcggctgggatcccttggcgcgctggcgagcaccatcaatattattgtgctggataacccgatgacctttgaattcagccgctttcttgacagcgcgctggggcagattgtcggctgtatcctggcgttcacggtgattgtgctggtgcgggataactcccgcgcacgtaccggacggatgctgctcaatcagtttatgtccgcggcggtatcgtccctgaccaccaataccgcccgacgtaaagaaaaccatctgccggcgctatatcagcagttgtttttactgctgagcaaatttccggatgatgtcgccaaattccgtctggcgctgacgctgatcatcgcccaccagcgcctgcgtgacgctccggtaccggtgaacgccgagctgtcggcctggcatcgccagttacgacgcacggcggatcaggtgatgtcggccaccagcgaccacaaacggcggcgctactttacgcagctgctgggtgagcttgatgtgtatcaggagaagctgcacagctgctccgcgccggatcaggtcactcatcctgtgaagcggctggtggatatgctccacaaatatcagcatgcgctgactgacagttaagcccacaaaccgacgccagaagcgtcggtttttttatggctatacttaacttcattgcccgaaaaccgaggctcaggaggatatatgacaacgcaggcacttcaggatcatgcgctattccagacaggttattttgttgatggagtatggaaaaaactggaaacgacctttgaggtcaccaacccggcaacgggcgaggtcatagcgaaagtcgcgaaagccggtaagaaagagacggaagaggccattgccgccgccagccgtgcctttcccgcctggcgcgcgaaaaccgctaaagaacgctctgcgatcctctatcgctggtatgaactgattatcgagaataaaagctggctgggacagctgatgaccgccgaacagggcaaaccactgaaagaagcggaaggcgaagtggactatgccgccagctttattcaatggtttgctgagcaggccaagcgcgccaacggcgaaatcatcccgcctgccaaagcgggctcacgcatctttgccacccgcgaaccggtgggcgtagtggcggcgatcacgccatggaacttcccgatggcgatgctgacccgtaagctcggcccggcgctggcggcaggctgcactgctttgatcaaacctgcaaataatacgccgctcagcgcctttgccctgatccagctggcgaaaaaagccggggtgccggatggcgtactgaacgccgtggcaggcaccacggcggaaatcagcgacgccattatggccagtccggaggtgcgcaaaatctcctttaccggatcgacggcggttggcaaaacgctgatgcgcaacgcggcggacaccatgaaaaaggtgtcgatggagctgggcggcaacgcgccctatatcgtcttcgaagatgctgatattgacgcggcagtgcagggggcgattgccaataaattccgtaacgccgggcaggtgtgcgtcagcgttaaccgtttttatatccatgagtcagtgtatgacacctttgtcagcaagctggcgagcgccgtcagcgctctgaaagtgggtaatggcgtggaagagggcgtggtggtcggcccgctgattgaaccttccgcagtagataaggtacgcgaacacgtcgaggatgccgtggcgaaaggcgcgaaagtgctggcaggcggtaaagcgcatgcgctgggcggcaatttctgggagccgacggtactgggcgactgtagcgatggcatgaagctggccgccgaggaaacgttcgggccgctggccgcctgcttccgctttacctcggaagaagaggtgatccgccgcgccaacgatacgccgttcggccttgcggcctatttctatacgcaaaatctggcgcgggtattccgtgtctcgcaggccattgaaagcggcatgattggcgtcaacgagtgtgcggtttcgaccgagctggcccccttcggcggcgtaaaagagtcagggctgggtcgcgaaggctcggtgctggggctggaagaatttatggaagtgaaaaccctgcatctggggggattataaacatcagcggcggctctcgccgcccgtgcgcgcgggatggctggcaatgaatactatctacacttttgattttgatgagattgaggaccagacggatttttaccgtgaatttgcgcgcgcctttaatattgagcgggcaaaggtgcacgatctggattctctctgggatgtggtgacagggggcgctttacccgtaccgctggagatcgagtttctgcatctggcggataaagagcgtcggcgctatggcgcgctgatcctgctatttgatgaagcagaagaagaactggaaggggcgctgcgcttcaacgtgcgggcctgaaacaaaaaagcccctgcagggcaggggcaatcatatagcactacggagggaattatttatagagttcagcagtggcgtgccagctgtcaccggtacgtgcttcgataatgcggtaagaagacgcaccttcttgctgagcttttttatccagtgcggcacgcatatccatcggagaggagttaacgccaccgacggaaacggtaccgattgactggcgggcctgtgcctgatcgctgccgataacgttcgcggcagatgcgccgaaggacaggacggaaaggatgctcagggcggctacagtggttttgattttcatgttgtttacctcgtcgaattcttttactgaaggcctttctttgtgaccttcatcacagaatcaagtatacactaatcacgcgaataattaataccatgctaatggtttcagtgtggttttggttacaaaattaactctttttattcctgaaaagcattaaaaatggcgaatttttgtcacgcgcggaaaggatcaatataaaaatcagagtgatagatgattttgattttttgtgcggttttattcactgggtgaatgtaatgggacagaaaatcgcactttctgttaaagaaatgtgggtgataaatagcggaaaaggggaaaaccgcagtggtatcccccaatagctacccgttgatgaggtggtttttacagctcctgctcaaatagcacaaggatcgcttcatacagctctttgacagtaaagccgctggccggcgtggtgaaaatcgtatcatcaccggcgatggtgccgagaataccttccgacttgcctaaggagtccagcagacgggcaatcagctgcgccgcgcccggactggtgtgaataaccactactgccgcgttgtaatcaatatccagcaccaggttcttcagcgggctggaagtcgtcggaacgcccagctcggcaggcaggcagtacaccatctccatcttcgcgttgcgggtgcgtaccgcaccaaatttggtcagcatgcgcgagactttagactggttgatgttatcgaaaccctgctcctgcaatgcgagcacgatttcaccctgggagctgaatttttcttctttaagcagcgctttaaacgctttaattaattcttcttgtttggccgaacttcgcataagtcacccgtggaatggcgagagaaacaccattattatgcatataaatgaatttttatgcaaattctcagcctgattaaaggctgaaataatgtaatgaaagggcgggattttatcaaaaaacgttatcgataaacatgcctgcgtcacgtgtctctgatttggttaaaagtaaattaaatgttatcaaattgatgttgttttgagggctttagtgggtgtattgtaccgccacggctcggttgctgacgctataaagccatgcagtttcccccaaagggcaacaggaagtgaatgatgctaaaagcgtgcgaggccgcattcttttgtcatggatattgttaacatttaccgaagttttaaaggtcgccagcaacggtttcaacatatttaccttaccataataaggagtttaggatgaaagttgcagtcctcggcgcggcaggtggtatcggccaggcgcttgcccttcttctcaagacccaactgccttcaggctcggaactctctctgtacgacatcgcgccggttacgccaggcgtggcagttgatttgagtcatatccctaccgctgtaaaaattaaaggtttctccggcgaagacgccacccctgcgctggaaggcgcggacgtggtgctgatctccgcaggcgttgcccgtaagccagggatggatcgctccgatctgttcaacgttaacgccggtatcgtgaagaatctggtcagccaggtggcgaaaacctgtccgggcgcctgtgtgggtatcatcaccaacccggtaaacaccaccgtcgctatcgcggcagaagtgctgaaaaaagccggtgtttacgacaagaacaaactgtttggcgtcaccacgctggacatcatccgttccaacacctttgttgctgagctgaaaggcaagcaaccgggtgaggtggaagtgccggttatcggcggacactctggcgtgaccattctgccgctgctgtcgcagatcccgggcgtgagctttaccgatcaggaagtggccgatctgaccaaacgtatccagaacgcgggtactgaagtggtggaagcgaaggccggtggcggttccgctacgctgtcgatgggtcaggccgctgcgcgctttggtttatcgctggtgcgtgcgctgtcaggtgaaaaaggcgtggtggaatgcgcatatgttgaaggcgatggcgaacacgcccgcttcttctcgcagccgctgctgctgggcaaaaatggcgtggaagagcgtcagtccatcggcacactgagcgcctttgaacaaagcgcgatggaaggcatgctggaaacgctgaaaaaagacattcagctgggcgaagagttcgttaaccagtaacggtctgggcagtctctgcatgctaaaaagccggaatattgttccggcttttttacgtctgctatgtagtggcggggtattcctggatagtgaccttaagggacagcttcttatcttcgcgcatcacctcaaccggaatttctgaacccgggcggatctccgccacctgatccatagtttccagcgccgataccgccggtttattgttcaccgagataatcacgtcgttcacctggatccctgcgcgcgccgccggaccgtccggcgccacttcgttcaccacaatcccctggatctgatcgatgccgccaccctgggtatgcagcggggcgatctctctgccgctgatgccgatgtagccgcggatcacccgaccgtcgcggatcagcttatccataattttggtcgccagctggaaggggatagcaaagccgataccttccggcgtttcgccgtcgttgctcttgtcaaaggagagggtgttgatgcccattaattcacccagcgagttaaccagcgcgccgccggagttgccgtggttaatggaggcgtcagtttgcaggaagttctgccgtcctgacgggttcaggccaatacgaccggtggcgctgacgatcccctgagtaatggtctgcccgaggttgtacgggttgccgatcgccatcaccacatcgccgatatgcggcatgcgtttacggttgatggggatcaccggcaggccgccggtggcgttgactttcagcaccgccagatcggttaaggcatcggatccaaccagcagggcttcaaacacccggccatcctgtaaggcgacgataatctggtcggcgtcattgatcacatgcttgttggtaatgatgtagccgcgctcgtccatgatcacccctgaccccagggtgcggatctccagctggttattggcggaggcattcacgctgcggttatagacgttaaccacggcaggcgcggcgcgacgtaccgcctggttgtagctcaccggcgtgtcgtcagcgctgtcaaatttgggcgtcgacaacggactaaactgacgtagagagggcatagcagccagaagaaggccaccaacaatcaaaccgattgcaacggagcgtatgagctttacaaacatgatgcaggcgtcaccagagagagaatgggcagcatagcatgagttatccggacatcacacgtggggatgatgtccggaaccacaaataactaacgtaataataaataaagcgtatcgttaccgcgtaccacgtgcagggcgatgatattcggtttcgcttccagcaccttgcgcatttccgctatcgtctgcacgcggtcccggttgacgccaataatcacatcatctttatgcaggccggcctgggcggcaggactgctcttttccacttcagagatggtgatccctttggtaccgtctttcagctggccgtcgtttaaggtcgcgccctgcaacgccggggcgatcatttccgcgctcgctgaagatgaggtgcttttatccagcgtaacttccacgtcctgcggtttaccgtcgcgcaacaggcccagcttcactttcgagcccggctcggtggtggcgatgcgggagcgcagctccgcaaagctgttcagcggttttccgttgaggctgacaatcacatcgccggatttgatccccgctttggccgagccggaattgggcagcacttcgctgacgaacgcgcctcgctgcacgttgaggttaaaggctttggcaatatccgcgctcatttccatgcctttaatgcccagcagtccgcgcttgatttcaccgaactggatcagctgtttggccagcgtttgcgccatgttgctgggaatggcgaaaccgatcccgacgctaccgccgctgggggcaagaatggcggtgttaatgccgatcagctcgccgttcaggtttaacagcgcgccgccggagttgccgcggttgatggaggcgtcggtctgaatgaagttttccagcccttcaagattcagcccgctacgcccgagcgctgaaacaatgcctgaagtggcggtctggccgaggccaaaagggttacccacggcgacggcgaaatcgcccacccgcaggctgtcggaatcagcgacggcgatttgcgtcagattggtggcattttgcagttgcagcagggcaatgtcgctctggtcatcgccgccaatcagtttggcttcaaattcacggccatcattcagctgcacattaattttctgcgcctggttgatgacatgattattggtcagcacataacctttggcggcatcgataatcaccccggagccgaggccttcaaacggctgggcttgctgatccggcgcgtcctcaccaaagaatttcttcagttcttccggcactttgggattttgctgcaccgcggtgccttccacctgcacgctgactaccgcaggcaacactttttccagcatcggcgcgaggcttgggatcgcggcctgacccggaacctgtgacggcaaggccgccatcgtctgtaacggcgcggcaagcgctaatccaacacctaacgctaacgcactcaatagctggttttttttcttcattgatgctggctctcgtaacctgaagtgtaaggaaaaacgccccaaaacagagggatgttattgaaattttgcacgggtaacaatgaggacaatgactaaataatagctgtgatgggaaagaagaggcgggcgcaacctgcgcgcccgtaaaaattctggcttaacagtcgtttaatcgcgtttcttcgcgccgcgcagcaggcctgacgcaccttctgagtagtcgcgcggcatctgtaccggagcctgatcgttacccgcttccgattcagcaaggcgattgcggaacggattcatctcggcggacatttccggcagcaactggctggagcttttcgccatgtgctggtacagctggcgataatcatgggccatgttatcgagcagctcggcgctgtgggcgaaatgtccgactaactcctcacggtactcttccagctcggccttatttttttccagctcgtattgcagggcctgctggttgcgtaacttgcgattaccgaaacgcatggctacagcaccaattacgatgccgacgactaaaccaattagcgcatattcccaggtcatgaacatctcccgttgtcttgtgattccgtagggtgttggcagggaggctcctcgcctgtgcctgattatgccactataaccgctaattccgtataagtggaatcctgaggctgcatcgcgtagtgtggaacggcctttttttcgtcaaccgtgaattacggcataccgatactcaaggaataacaataacatcatgcaaagtattacccccacatcgcgataccagcaagccctggatgcgggtacgcatcagccagacgaggtgcagcgcgcggcggttaaccggctggacgctatctggcagcaactcacgcaaacccacactacgcctgcgccacgcggcggcctgatggcggccttcggcaaactgctcggtaagaaagaagaatcgacaacccctcccgtacgcggcttatatatgtggggcggcgtcgggcgcggcaaaacctggctgatggatctgttttttcagactttgcctggcacacgtaaacagcgtctgcactttcaccgctttatgctgcgcgttcatgaagagctgacggcgttacagggagagagcgatccgctggaaatcatcgccgatcgctttaaagccgaaaccgacgtgctctgctttgacgagttttttgtgtcggacataaccgacgccatgctgcttggcggcctgatgaaagcgctgttctcgcgcggcatcacgctggtggcgacctctaacattccaccggatgagctttaccgcaacggcctgcaacgcgcgcgcttcctgccggcgattgaggctatcaaggcaaactgtgacgtgatgaacgtggacgcgggcgtcgattaccgtctgcgcaccctgacgcaggcgcatctgtggctgtcacccttaaatgacgagacggcgcagcagatggaaacgctgtggctggcgctggcaggcgcgccgcgcgagcagcggccagcgcttgagatcaatcatcgcccgctgcaaaccctgggggcggaaaatcagacgctggcagtttccttcactacgctgtgcgtcgaggcgcgcagtcagcacgactatattgcgctatcgcgtctgtatcacacggtgatgctctacgacgtgccggtgatgacgccgctgatggagaacgaagcgcggcgctttatcgcgctggtggatgaattctacgagcggcacgtgaagctggtggtcagcgcgcaagccccgttgcatgagatttatcagggtgagcgggtaaaatttgaattccagcgctgcttgtcccgcttacaggagatgcaaagcgaggagtatctgaagcgcgagcatctggcataatcgcctccccaggcacggcgcggggaaaagtatcgtcgcaatcacaaaaaggggtcgatctttgtacccgacttccctataatcttgcgaccccacgttacgagaaagtttttttcccaaaacttttgtgtgccggcataggctattcgaaggggtaggtttgctggacaatgtcgtgtgaacctcaactgactaaacgtttgggtgttcaccaacgtgtaactatttattgggtaagcttttaatgaaaacttttacagctaaaccagaaaccgtaaaacgcgactggtatgttgttgacgcgaccggtaaaactctgggccgtctggctaccgaactggctcgtcgcctgcgcggtaagcataaagcggaatacactccgcacgtagatactggtgattacattatcgttctgaacgcagaaaaagttgccgtaaccggtaacaagcgtactgacaaaatgtactaccatcacaccggccacatcggtggtatcaaagaagcgacctttgaagagatgattgcccgccgtcctgagcgtgtgattgaaatcgcggttaaaggcatgctgccaaaaggcccgctgggtcgtgctatgtaccgtaaactgaaagtttacgcgggtaacgagcacaaccacgcggcacagcaaccgcaagttctggacatctaatcgggattatggcaatggctgaaaatcaatactacggcactggtcgccgcaaaagttccgcagctcgcgttttcatcaaaccgggcagtggcaaaatcgttatcaaccaacgttctctggaacagtacttcggtcgtgaaactgcccgcatggtagttcgtcagccgctggaactggtcgacatggttgagaaactggatctgtacatcactgttaaaggtggtggtatctctggtcaggctggtgcgatccgtcacggtatcacccgcgctctgatggagtacgatgagtccctgcgtggcgaactgcgtaaagctggcttcgttactcgtgatgctcgtcaggttgaacgtaagaaagtcggtctgcgtaaagcacgtcgtcgtcctcagttctccaaacgttaatctgtttctgctcaggcagaatacagttggcgaaaaaacccgctccggcgggtttttttatgcctgaaaatttagttatccactgtaatagcttgattcctgcctctttttgagcaattgcgcaataccctcaccacaaagcccgcaaaatctggtaaactatcatccaattttgtgcccaaatgccggggatagttcattttttgtttaaatattgaacaatgaaatgtacccgggtggatagattacttacatctggcgagccacgttgtggtttgcagcagtaatattctgaatatacctggaggttttcatggctgtcgctgccaacaaacgttcggtaatgacgctgttttctggtcctactgacatctatagccaccaagtccgcatcgtgctggccgagaaaggtgttagttttgaaattgagcatgtggagaaggatcatccgcctcaggatctgattgacctcaacccgaatcaaagcgtaccgacacttgtagatcgcgagctgaccctgtgggaatctcgcatcattatggaatatctggatgagcgttttccgcatccgccgctgatgccggtatacccggttgcgcgtggtgaaagccgcctgtacatgcagcgtatcgaaaaagactggtactcgctgatgaacgttgtcgtgaacagcaccggtgctcaggcggataccgcccgtaaacaactgcgtgaagagctgctggctatcgcgccggtatttggacagaagccttacttcctgagcgatgaattcagcctggtcgattgctatctggcgccgctgttatggcgtctgccgcagctggggatcgaactcagcggcgcaggggctaaagagctgaaaggctacatgacgcgcgtctttgaacgcgattccttcctcgcttcactgacagaagccgaacgcgaaatgcgccttggccggggttaataagcatggaaatgtcacaactgtctccacgccgtccgtatctgctgcgcgcattctatgaatggttgctggataaccagctcacgccgcatctggtggtagatgtgaccctggaaggcgtgcgtgtgccaatggaatatgctcgtgacgggcagattgtgttgaatatcgcgccgcgtgctgtcggtaatctggagctggctaacgacgaagtgcgttttaacgcgcgtttcggcggggtgccgcgccaggtgtacgtcccgctggctgccgtactggcaatttatgcccgtgaaaacggcgcaggcaccatgtttgagccggaagcggcgtatgacggcgacgccatttctctcaatgacgatgacgagactaccacgcctgagggtgaaactgtcatgtccgttatcgacggcgacaagcccgataacagtgatgacaacgatcctgatgacgatccgccgccgcgcggtggccgtccggcattacgcgttgtgaaataaactgacaggccccgacgggcctgttttttttgcctttggtaacgccatcccgcaccaggtgcgccagcctgatattcctgtgttatgatgagcttgctgtcacacactacttatccgggcgctatgaacgcatttgatcctgactccgacaaccctgctgaaaaggtcgcgcgcacgctgcgtcgtcgtccgctggcgcgtaaaaagctctcagagatggtggaagaagagctggagcagatgatccgccgccgtgaagtggctgagggtgaacagctgccgtctgaacgtgaactgatggcgctgttcaacgttggccgcccgtcggtacgcgaggcgctggccgcgctgaaacgcaaaggcctggtgcagatcagcaatggcgaacgggcgcgcgtatcacgcccctcagccgataccatcgtcagcgaactctccggcatggcgaaagactttctctcgcgccccggcggtatcgcccattttgaacagctgcgtttgttctttgaatcaagcctggtgcgttacgccgccgagcacgccaccgacgcgcagattgaacagctcagtaaagcgctggaatggaacagccagacgctggacgacaacgcgctttttatccgctccgacgtcgagtttcaccgcgtgctggcgcaaattcccggcaaccctattttcaacgccattcatctctccctgcttgactggctgatcgccgcgcgtccggccgtaccggaaaaagagctgcatcagcacaataacgtcagttatcagcagcatattgagatcgtcaacgccatccgccagcgcgatccggatgctgccgatcgcgccctgcatacccatctgaacagcgttttcgccacctggcacgccttcgacaaaaagaaaaaatcccgcgcctgatcccgcattgccttaacgatcctcaaacgatcgtttagtgaggcagatcccattccctgcatttggggacaaaatgtcgattttgtgtgctggtataataggtataaaggtatatagtcaggcaatgataacccatcaggagaagttcatgtctgttcagttaaaaggcgttatgcccgccctgttaacccccttcgacgccagcgaaaatctggataccgaaagcctgcgccgtctggtgcgtttcaatatcagtcagggcattgatgggctgtacgtcggcggatccaccggcgaagcctttgtccagagcattaaagaacgtgaagaagtgctggagatcgtggccgaagaagcgaaaggcaaaatcacgctgattgcccatgtcggcaccgtcagcacgcgggaaacgcaacagctggcgacagctgccagccgttacgggtttgacgccgtctccgccgttacgcccttctattatcctttcagctttgccgagcactgtgaccattaccgggcggccattgatgctgccgacggtctgccgatggtggtttacaacatcccggcgctgagcggcgtgaagctgtcgctcgatcaaatcagtaccctggtcacgctgccgggcgtcggcgcgctgaaacaaacctcgggcgatctttttcagatggagcagatccaccgcgcgcacccggatctggtgctttataacggctatgacgagatcttcgcttccggtctgctggcgggcgcgaatggcggtattggcagcacctataacattatgggctggcgctatatggggattgtgcgcgcgctggcggaaggggatatcgccaccgcgcaacgtttgcagaccgagtgtaataaagcgatcgatctgctgatcaaagtgggggttttccgcggcctgaaaactatcctgcactacatggacgtgctgacggtgccgctgtgccgtaaacccttcggcccggttgatgaacaatacctgccagaactgaaagcgctggcggatcggctgcttgctgagaagtgctaacctgatgccgggcggcaacaggtcggcccggccatgaaaaacagaccgagcgtcgggagaatgttatgacaatgcctgcccagagcatcccgtggtatcgccatcttaatcgcagccagtggcgggcgttcagcgccgcctggcttggctatctgctggatggttttgattttgtattaatcgcgctggtattaaccgagatccagggcgaattcggcctgaccaccgttcaggcagccagcctgatttccgccgcctttatttcccgctggttcggcgggctgatgctgggggcgatgggggaccgctacggtcgccgcctcgccatggtcaccagcatcattttgttttctgtcggtaccctggcctgcggtttcgcgccgggctacaccaccatgtttatcgcccgtctggtgatcggcatggggatggcgggtgaatacggctccagcgccacctacgtgattgaaagctggccgaagcaactgcgcaataaagccagcggctttttgatctccggtttttccgtgggcgcggtgatcgccgctcaggtttacagcctggtggtgccggtatggggctggcgggcgctgttctttatcggcatcgtgccgatcgttttcgcgctctggctgcgtaaaaatattccggaagcggaagactggcagcaaaaacatgccggtaaagcgccggtgcgtactatggttgacattctctaccgcggcaaactgcgcattctgaatatcctgatgacaatagccgccgccagcgcgctctggtactgctttgccgcgcaaatgaaaaacgccgcgctggtgattgcctttggtctgctgtgcgcggcgatctttatcagctttatggtgcaaagcagcggcaaacggtggccgacgggcgtgatgctgatggtggtggtgctgtttgccttcctctattcatggcccattcaggcgctgctgccgacgtacctgaaaaccgaactggcttacgatccctccaccgtggcgcgggtgctgttcttcagtggctttggcgcggcggtgggctgctgcgtggggggctttctcggcgactggctgggcacgcgcaaagcctatgtttacagcctgctggcctcgcagttattgatcatcccggtattcgctattggcggcgccaatgtctgggtgctgggctttttactcttcttccagcagatgctggggcaggggatctccgggatcttacctaagctgatcggcggctatttcgataccgatcaacgggcggcggggctgggcttcacttataacgtgggggcgctgggcggcgcgctggcgccgattatcggcgcactcttcgcacagaaaatggagctgggcaccgcgctgggatcgctctctttcagcctgacctttgtggtgatcctgctgattggtcttgatatgccgtcccgcgtacagcgctggttgcggccggaagcgctgcgcacccatgacgccatcgatggcaaaccctttagcggcgcagtgacgcataacgcggacaaaagcgacttactgaaaacaaagcgggcggcgaaatgatcactctggctatcgacatcggcggcaccaaacttgccgctgcgctggtggacgcacacgggcgattatcctgccgcgccaccctgccgacacccgccagccgcacgcctgatgcgctggaggccgccctgcgcgatctgctgacgccgctctacccgcgtgcgcagcgcttcgccattgcctccaccggtatcattcaggatggcgtactgacggccattaacccggaaaaccttggcggactggcgcattttccgctggtggcctgcgtcgcgagcatcaccggcttgccgggagtggcgctaaatgatgcacaggcggcagcatgggcagaatatcagccgctggcagctcgtgtgcgtgacatggtgtttctgaccatctcgacaggcgtcggcggcggcctggtgcgtgatggcaggctggtcaccggacagggcgggctggcgggccatttcggccatacgctcgccgatccgctcgggccgcgctgtggctgtggacgtaccggctgcgtggaggccatcgcctccggacgcggcatcgcggcggcggcagagggcgaactggctggctgtgacgcgaaaaccctgtttgccctgagcgagcaggggcatgcgggagccagtacgctggtgaacagatcggcaaccgcgctggcacgcctgatcgccgatgtgaaggccgccaccgactgtcagtgcgtggtgctcggcggcagcattggtctggcacccggctatcttgcccgtgtgcggacggcgctgttacgcgaaccggcgatgtaccataccgaattactgactgcgcattatcagcacgacgccggactgctcggcgcggcctggtgggctaacgggagaaaagcatgatttacggagatattcaccagccggaagcggccggtttacccgccggattgctggatgcgctgcgccaggcgctggcattagcgccggagcagctatcccccggacggcacgaactcgccggtgcggcgtgctttatgaacgtgatgcattacagcacgcagttgccggacacaaaaaaggcggaactccaccggcagtatgtggatgtgcaggtggtgcttaccggggaagagcagattttttacggcgctgcgggcagtgcgcgcgagtgcgaagagtggcatgatgcagacgattatcagctgtgccagcacattgataatcagcagaggctgaccctgcgcgccgggatgtttgccgtatttatgcccggtgaaccgcataagcctggctgcaccatggggcgggagagcgaggtaaaaaaagcggtgattaaagttccctgcgaggaagccactggctgaaatgcgggggcgaaaaatatcgcccccgcatttattaccagcgatagttccagagaatatggccgccgtaagcgtcgtagctgttttcgccccattcgcccgtggcgcgtacggagagcgtcattgcttcattgagcttaccggtgatcccgacctcgaccagggcgcgatcttccggcacatcgttactcagcgtttcgccgttaaactgcaaatcggtcgcgccgtcgccgttaagccagttaaccgatgtccacggctgccagtctcccggcgctttctgattgaggttgctgacgcgtacgcccagacgggtcagaatgctgtccttgtcgctttgcgtaatgcgcgtaccgttaacctcggtatgatcgtcctgatcgagatagctgtagatgatctggccctgaggctcgatcttccagctgcgatcttcttcaccgctaaccagccaggcgtggcccatttccagcgaggcggcatagccgttgctcttgtaatcttcagagtcgaggccatcgccacgaacgtagccgtcataccagttagcctgcacccagctgtccacatagctgccggtacgtaactgtggatcctgctgccaggtggcatacagcccgacgttataaccgctgacttttcccttcgcggagttgcggttattagtggcatccgcatgcgtgacgctcagacctgcgccaagcataaagccggcatgcagttcgccttcatcataggtgcgggtatagagatcgctgccgacctggaagacggtggtggtggtgtcataaccgcctttcgcatccgctgcggtaccttcgttataacggcctttgacgtacatccagccattttgttcgccttcattacgcgccagcacctgctcgcgatcgtccagcttgtgcaggaacatttgctgtgcagcgctctggttagcaagataagcgctggtttccggacgaatgacttcaggggatttatcttcatcgccgttgccgttatcaccaccgttgccgttatcgccaccgttgccgttatcgccgccgttgccgttatcgccgccgttaccgttgtcgccgccgttgccgttatcgccgccgttaccgttatcgccgccgtcgccattgtcgccgccgtcgccgttatcgccgccgttgccgttatcgccgccgttaccgttatcgccgccttcgccgttgtcaccatcgccgttgtcatttggatcgggttctttttccgaaaccagataccagtctccatcgcgctttttaagatcgtattcccaggcacccgctacggcacgggatgagagagtgaatacggcatcggaagtctgcccaacctcaataatttcaatgccgttgattgtctgcgcgccctggccgccgatattggtcagcgccactttcgattcaccgctggtattaccggtgatggtcagcatgtccgtcgcggcgttgtcatccgccagggtggtattcattattagctggctgccggcattaccaacataatcaccattgatggtaaaacgctggcctggctgggtgtttgcgctgccaataatcagcgaaccgctgttgctgacgttaccctttatggaatccgcagtagcggaagcggtattacctgtcgtcgccacattccaggccgccagcgtgccgcccgccataatattcacgtcgcccgttaccgtaccggcactggccagggtggcgctattgttgatggtgacgctggcaggcgcagcggccgtgcccagcgcgctgtctttggcgaccagcgtggtaccgccattgagttcagtgccgccggtgtaactgaatacaccgtcaagcgtcagggtgctggcatcggatttaataagtttaccctggccgctgatatcactgctaaaggtggagtcgccgctctggttaattatcaggttgccgttattggtaactgcatcagaggtaaaggccgcagtgtgcgtagcatcccctagttgtaaggtagcaccctgattaatagtggtgccgccagcattgttcatggttccggtcagcgttaaggtgccagtagtgacctgcaggactttgtcattaattttctgagatccgttaccaagcaaatcaatgttaccactcaaggtccacgcctcgcccctcatattgagtgaagcgaatccgtcatcctcatgaaaaccaataaaattgctattttctgtcccagaaccttctaatataagtttattctttaatgattttgtactaagaacatcaccttcaaggttagagccactttgtaatacaagactattttgttcggaagattcaaactttattgcgtactgatttccatgaattgttccagcattacttatagaagaactaccatttccttttagcgctatccccgcatcattttcactggagattactgcgctatttatgatggttgctgaaccgctagttatttcaattgcacttccattagtggagctaataattcctttattatcggcggcaaaattatcgctggcaactattgcattttcagttccgcttatttttcccttttcataattattaacgttgatgcttgagccattaattatattaattgcgtaagtattgccgtcaattattcctttattggtgagttcacctttcattttattaatatcaatggcggtgcccgcgctattttcgatagtgccttcattgataacagaagtaataaagccatcattaatatttaaagttggcttagttgataaattaatatcaatagaagtttcactttcgatattataagaagtgtcagtgtcatctaataccccaggtgcggtgattgttgcagcaaacgccacagaagacgaacaaaaagcaatagtgggcattaattttaatattgttttggtaatcaaatttaattgatgcggtgtatacgacataattacttccgttgtaagaaatgaaataagcggggcatactattcttaagctttcattaagtaaacggttgcgactgtgtcgctatgccgatagttacaaataaccgtaattttaagagtgttttattagatatgtgaatgtgaactattgtaattattgacgtaaaaggaaggatcgcggttaaaagggaagtactaacaggaattattaacaggaggggtggggcaattattaactaaatatattgatcgcagaaatgaatatccgtggcagtgtattaacacaccgccacggttatagcttatacttccagccagttcataatgccttctgccgctttacgcccttcggcgatggcggtgaccaccagatccgaaccacgcacgatgtcgccaccggcaaagattttcggattgctggtctggaaggcattttcattaccttccggcgcaatgatgcggccctgcgaatccagctcgacgctgtgtttcgccagccattccatgctgtgcggacggaaaccaaacgccattactacggcatcggccggtaacacgtgttcagagcccggtacgatctctgcacgacggcgaccatgggcatcaggcgcgcccatctccgtgcgcgccattttcacgccgctcactttgccgttggcattcacttcaatgcccagcggctgcacgttgaactggaactccacgccttcttcacgcgcgtttttcacttcgcgacgggaacccggcatgttctcttcatcacggcgataagcacaggtaacgtgcgtggcgccctggcggatggacgtacgtacgcagtccatggcggtatcaccgccgcccagcaccactacgcggcgaccttccatgctgacgaacggcgcgtccgtagtttcaccaaagcccatcagctgtttagtgttggcgataaggaacggcagcgcgtcgtacacgccggacgcatcttcattctccagcccaccgcgcatcgactgataggtgccgacgcccaggaacacggcatcataatctttcagcaaatcctcaagctgtacgtcgcggcccacttccacgttcagtttgaattcaatacccatgccggtgaaaatttcacggcgacgggtcatgacttctttttccagcttgaaggccggaataccgaaggtcagcaggccgccgatttccgggtgacggtcaaagaccaccgctttcacgccgttgcgggtcagcacgtcggcacatgccagacctgccgggcctgcgccgataatcgccacgcgcttatcggtctgacgtacaccggtcatgtccggacgccagcccatttcaaacgctttatcattgatatagcgctcaatgttgccgatggtgaccgcgccaaactcgtcgttaagcgtacaggagccttcacacaggcgatcctgtggacacacgcgaccgcacacttccggcagggtgttagtctgatgcgacaattctgccgcttcaaaaattcgcccttcgttggccagcttcagccagttaggaatgtagttatgaaccgggcatttccactcgcagtagggattgccgcaggacaggcagcgatctgcctgtgctttggcctggccttctgaaaacggctcgtaaatttcaacaaactctattttacggatcttcagcgcttttttcggcggatcaacgcgctgtaagtcaataaactgatagacattctgactcattgcttccccttactgcgcctgcacccgcagctcagctgcggaacgactacggtgacccaacagtgctttaacatcgctggacttcggtttaaccagcgcgaatctggtggagaatgctggccagttcgccaggatctcttcgccgcgtgaggagcccgtgtgctgcacgtgctcggtgatcaaaccgcgcagatgctcttcatggatggcaagatcatcgacgctcagcacttccaccagctccgggtttacacgcttacggaattcgccgtcttcatccagtacgtaagcgaagccgcccgtcataccggcaccgaagttaacgcccgttttacccagaatgcagacaataccgccggtcatatattcacaaccgttatcgccaatgccttccaccacggtgatggcaccggagttacgcacagcaaaacgttcacccgcgcggcctgcggcatacaggcgaccgccggttgcgccatacagacaggtgttaccgataatgctcgccttatggctgaggaaagctgaacccaccggcggacgtaccgccagcagaccgcccgccatgcctttgcccacgtaatcgttagcatcgccggtcagatacagctccacgccgccggcgttccacacgccaaagctctggcctgcggtaccgctgaagtgcgctttgatcggatcggctgccagtccctgatcgccatgcttctgggcgatataaccggacagcgacgcgccaacggagcggtcggtgttgcgaatatcgaaccagaaggttttgctctggccttcatccacataaggttttgcctgtgacagcaactgggcgttcagcacgccgttatcaaacggcgggttgtgctcggtgcagtacagcgctttaccaggatgcggctcggcggtttccagcagtttgctcagatccagcttttgctgcttagcggtataaccttccagcgcgatcagcagatcggtgcggccaatcagatccaccagacgtttcacgcccagttgcgccatcagctcgcgggtttcacgggcgataaattcaaagtagttggtcactttgaacggcagaccgtggtaatggtttttacgcagtttgtcatcctgggttgccacgccggtagcgcagttgttcaggtggcaaatacgcaggtatttacagccgagcgcgaccatcgggccggtgccaaagccgaagctttccgcgccgagaatggcagctttaataatatcgacgccggttttcaggccgccgtccacctgcaggcggatcttatggcgtaagccgttggcaaccagcgcctgctgggtttccaccagccccagctcccacggacagcccgcatatttcacggaggagagcgggcttgcgccggtgccgccatcgtagccggcgatggtgatcagatccgcataggctttagccacgccggtggcgatagtgcccacgcccggctcagacaccagcttcacggaaatcatcgctttcgggttgacctgttttaagtcaaaaatcagctgcgccagatcctcaatggagtaaatatcgtggtgcggcggcggcgaaatcagcgttacgccaggcacggagtagcgcagtttggcgatgtacggcgtgactttatcacccggtaactgaccgccttcgccaggcttcgcgccctgggccactttaatctggatcacatccgcattcaccaggtaggccggggtaacgccaaagcgtcccgaagccacctgtttgatgcgcgacactttattggtgccgtagcgcgccggatcttcaccgccttcgccggagttggaattgccgccgatgctgttcatcgcttccgccagcgcctcgtgcgcttccgggcttaacgcgccgatggacatggctgccgtatcgaagcgtttgaacagttcctgcgccggttccacgtcgtcaatgctgacggcgtcggcaggcggattgatagccagcagatcgcgcagcgtcgccgccgggcgttcgttaaccagtttcgcatactgctgatagtcgctgtactcgccggtttgcaccgcctgttgcagcgtgcgcaccacgtccgggttataggcgtggtattcaccgccgtgcacatatttcagcaggccgcccgcatccagcggtttacgcgccagccaggcacgcttcgacaggttcagcagatcctgctggaagtcgctgaagcttgcgccgccgatacgactgatcacgccctggaagcagaggttcgccacatcgtcatgcagaccgaccgcttcgaacagcttcgagcagcggtaagaggcgatggtcgagatgcccattttggacatgatcttgtacagacctttgttgatgccgttacggtagttcagcatcacggtacggtagcttttctcaatggcgcgggtatcgatcagtttcgccagggtttcataggcgagatacggatagatagcggtggcgccaaagcccagcagtacggcgaagtggtgcgggtcgcgcgcgcttgcggtttcaacaatgatgttggcgtcgcagcgcagatttttttccaccaggcgagtctggatcgcgcccactgccatcggcgccggtaccggcagacgatctttggcgatgttgcgatccgagagcaccagcagcaccgtgccgtcgcgcaccatggcttcggctttatcacacagcgctttgacgacctcttcaagcgtgctttcattcacgtcaaaggtgatgtccagtgtgtcggcgcgatagtgatgctccgtcatggtggtgagctgtttgaaatcggagtacagcaggatcggcgatttgaaactcaggcggtgcgcctggccttctgcttcacagaagacattcatctcgcggccaatgctggtggccagcgacatcacgtgcgcttcacgcagcggatcgattggcgggttggtcacctgcgcaaactgctggcggaagtaatcgtaaatgatgcgcggctggctggagagtacggcaaagggggtatcgtcacccattgaaccgaccgcttcctggccgttttcacccagcacgcggatgatggaatccagctcttccgcgctgtagttaaactgtttctggtagctgcccagcagatcgtcgcccatttcgcggctgccgacttcttcgtcaggcagatcttcaaagggcaccagacggcggacgtttttctccatccactctttgtaggggtgacggcttttcagatcgtcatcggtttccgcagagtgcagaatacggccgccgcgggtgtcgatcaccatcagctcgcccggccccacgcggcctttttccaccacctcgtccggctgataatcccagatgcccacttcagaggcgcaggtgatcagcttatctttggtgataacgtagcgcgccgggcgcagaccgttacggtcgaggttacaggcggcgaaacgaccgtcggacatcacaatgcccgccgggccatcccacggctccatatgcatggagttaaagtcgaagaacgcgcgcagctccggatccatgtccgggttgttctgccaggctggcggcacgagcagacgcatggcgcgcacgatgtccataccaccggcaagcagcagctccagcatgttatccatggagctggaatcagagccggtttcgttgacgaaaggcgcggcatcgtgcagatccgggatcagcggcgtctggaacttataagtacgcgcgcgcgcccactgacggttaccggtgatggtattgatttcaccgttgtgcgccagatagcggaacggctgcgccagcggccagcgcggcacggtgttggtggagaagcgctggtggaacaggcaaatggctgattccaggcgcaggtccgccaggtccaggtaaaagcgcggcagatccgccggcatacacagacctttataaatgttgaccaggttcgacaggctacaaacgtagaaatctttatcttccaccagacgcttttcaatgcggcggcgcgcgataaacaggcggcgctccatatcgcgtggacgccagcccgcaggggcgttgacaaagatctgctcaatacgtggcagcgaggagagggcgatttcaccgagcaccccttcattggtgggcacgtcgcgccagccaacaatcgacagggtttcctgttgcagctcttcttctacaatacggcgcgaggcggcagctttttcaggatcctgattcaggaacagcatgccaacggcgtagtttttggccagccgccagccgcgctcttcggcaacgatgcggaagaaacggtcgggtttttgcaacagtaaaccgcagccatcgccggttttaccatcggcaaggatcgcgccacggtgctgcattcgggccagtgcgtgaatagcggtacgcactaccttgtggctaggttcgccttctatgtgggcgatcaggccgaaaccacagttatccctctcaagggatttatcgtacaacatatcagtgaacctccccaggctctacgggagtccgtcttaaccgacgcgcacaggcgcagaaagagcatggcgacggggctttaaggcctcgggtgtcgccctcttttttttccttttcgcatcggtacacaagtgttgaggacttgctttaagagggaatctcaattactgcatatcacttcatccttcggaccgcctcatcgttggctgccttcgttcatcccagtcacatagtggactatgctcctgtgattcactcagttgccgccttgatgcagcccgaatgattttgtgcataaatatgatgagcagactgctcacccagaaagcttccagcggatcctcaagttatcgggaatcggcacacaggtcaaatggcaatcttatttatacaaaaatgtgctaaaggttggttaactagttgtttttaatgttttttaatgctctttttgccactatgtcaggcctggcggccgttaatggagtgtgatccctctcactataagaaagcgctgttattaccgcgctgtcctgcgttctgttttgcaaacagaatattacactggcttttcttcctaacccgcttaatgccactgttttgcgccgaaggaattctttttgaaaaatatcccgccgacataagtaaaagtaatcagcgaagcagtgaatgaaatctcggtaattgtgcgtgtttatgcaatagatgtgcgtcctctatggcgattgatccaggtcatcgccgacaaagactaaaaatggcaggcttggccctttcatcaggccggtctatcaatttatgcagttacagaaattagtcaatatgtttggtggcgatctcgcccgtcgttacgggcagaaggtccataaactgacgctgcatggcggtttcagttgtcccaatcgtgatggcactatcggacggggcggctgcactttctgttacgtggcttctttcgctgacgaaacccagcagaaccactccattgcggagcagctggcttatcaggccacgctggtcaaccgcgccagacgatatctcgcctattttcaggcctacaccagtacctgggcggaagtgcaggtgctgcgcgccatgtatcagcaggcggtaagccaggccagcatcgtcggtttatgcgtcggcacccgcccggactgcgtgccggatgcggtgctggatctgctcagcgaataccatgacgcgggctatgaagtgtggctggagcttgggctgcaaacggctcaggataaaaccctgcaccgcattaaccgcggccacgattttgcctgctaccagcacaccacccgccgggcacgcgaacggggtctgaaagtgtgcagccatttgattgtcggtctgccgggagaagggcaggccgcgtgtctggacacgctgcaccgggtggtggagacgggcgtggacgggatcaaactgcacccgctgcatattgtcaccggcagcaccatggcgaaggcctgggaagcggggcgtctgcacggcattgcgctggaagactacaccgtcaccgccggggagatgatccgccatacgtctcctgaggtgatttaccaccgtatttccgccagcgcgcgtcgcccgacgctgctcgccccgctgtggtgcgaaaatcgctggaccggtatggtggaactggaccgctaccttaacagccacggggcgcagggatcggcgctgggccgcggctgggtgcagccatgcgtctgaacgtttccttcctgagcggggaataattcgcactttttcacacaagcgtcaacgccttgctcagaattgagtattattgtgccaggttgtcgcgaagggatcccctatgaagcaaatccgagtactggcgcaatactatgtcgatctgatgatgaagctcggcctggtgcgcttttccatactgctggcgctggcgctggtggtactggcgattgtcgtgcagatggcggtcaccatggtgttgcatggccgcgttgaaagcattgatgttatacgctctatcttctttggtctgctcattaccccctgggcggtctactttctgtcggtggtggttgaacaactggaagaatcgcggcagcggctctcgcggctggtggataagcttgaagagatgcgcgaccgcgatctcaagctcaacgtacagctgcgggataacatctcccagctgaatcaggagatcagcgaccgtgtgaaagcggaagcggagcgccaggccactttcgagcagctaaaaatcgaaatgcaggagcgcgaacagacgcagatccagctggagcaacagtcttctttcctgcgctcgttcctcgatgcttccccggatctggttttctatcgcaatgaagataaagagttttccggctgtaaccgggcgatggagctgctgaccggcaaaagcgaaaaacagctggtgaatctgaagccgcaggacgtctattccccggaagctgccgagaaagtgctggaaaccgacgagaaagttttccgccataacgtgtcgctcacgtatgaacagtggctggattacccggacggacgtaaagcctgttttgagatccgtaaagtaccctattacgaccgcgtgggtaaacgccacgggctgatgggcttcgggcgtgacataaccgaacgtaagcgctatcaggacgcgctggagcgcgccagccgcgacaagactacctttatctctaccatcagccatgaactgcgtacgccgcttaacggtatcgtcggtctgagccgtatcctgctggatacggagctgaccgccgaacaggaaaaatacctgaaaaccatccatgtttcggcggtgaccctcgggaatattttcaacgatattatcgacatggataaaatggagcggcataaagtccagctggataaccagccggtggacttcaccagcttccttgccgatctggaaaacctctccgggctacaggcgcagcagaaagggctgcgcttcgtaatggagcctgcgttgccgttgccgcataaggttgttaccgacggcacgcgtctgcggcagatcctgtggaacctcatcagtaacgccgtcaaattcaccctgcacgggcaggtggtggtgcgggtgcgctatgacgctccgcaggagatgctgcgctttgaggtggaagattccggtatcggtattccgcagaccgaacaggataagatcttcgccatgtattatcaggtgaaagacagccacggcggtaaacccgcgacggggacgggcattggtctggcggtatcgcgccgtctggcgaagagcatgggcggcgatatcacggtgtccagcgtggcgggcaaaggttcggtcttctcgctgtcggtgcgcgcccctgctgttgcggaagaagtagacgatgcgttcgaagaagatgaaatgccgctgccggcccttcacgtcctgctggtggaagacattgagctgaacgtgattgtcgcccgttcggtgctggaaaaactgggttgcagcgtggatgtggcgatgaccggcaaggcggcgctggagatgtttacccccggcgaatacgacttgctgctgctggatattcagctgccggatatgaccgggctggatatttcccgccagctcaccagccgctatgcggctgaagatctgccgccgctggtggcgctaaccgccaacgtgctgaaagacaaacaagaatacctgaacgccggtatggatgatgtcctcagcaaaccgctggccgtaccggcattaacggccatgatcaaaaaattctgggatacctgtgacgacgaggagagtgatgtgacccctgtggatgacagtaaatcacaagcgctgctggatctgccgatgctggaacagtatctggagctggtggggccgaagctgatcaccgatggcgtggcggtatttgaaaaaatgatgccgggctatatcagcgtgctggagtccaatttcaccgcccgcgatcagaaaggcatcaccgaagaagggcataaaattaaaggcgcggcaggatcgattggcctgcgccgtttacaacagctggggcaacaaattcagtcgccggatctgcccgcctggtggaataacgtgggcgaatggatcgacgagatgaaacaggaatggccgcatgacgtggcgttactgaaagcctgggtggcgaatgccagtaaaaaataaccccggataaaccggggtgcgcgaatactgcgccaacaccagggaaccgtggctgcgccgggattgtgattttgtagttgaacgggcacggcgagacatgagaaaagttggcacttaagataccaaaacttgaatcatttgttacgtgaatcagttaaatgtgtgaagcacagcgttgttatcacaataattaataaaattcagcctattgccagaaaggatgagcagcatgaaaaaagtaggtattgtccttagcggatgcggagttaacgacggatcagagatccacgaagccgtactttctctgctggcgatcgcccgaaacggtgccgaagccgtttgttttgcgccggataaaagtcaaagcgatgtggtgaatcatttgactggtgaatctatggcggacagccgcaatgtgctgatcgaagcggcgcgtattgcccgcggcgccattcagccgttagccctggcgtccgctgatacgctggatgcgctgatcgtacctggcggttttggcgcggcgaaaaacctgagtaattttgccagccagggggcggaatgcaccgtcgaccccgatctgaaacgtctggcgctggcgatacatgcggcgggcaaaccgctgggctttatctgtatcgcgccggcaatgctgccaaagattttcgacttcccgctgcgtctgactatcggcacggacattgacacagctgagttgctggaagagatgggcgcggaacatgttccctgtccggtggatgatattgttgtggatgaagacaataaagtggtgactaccccggcttatatgctggcgcagaatatcgcggaagcggcaaccggcatcgataagctggttgcccgcgtgctggttctcgcggaatgaaacggcgacgcgctccgctgatggcgacgttaaaatcctggctatggaggatcctgctggtgctgatcctgttctggggcggcggcatcgcgctgttttccttcatgccggtgccgttttccgcggtaatggcggagcgccagctttcggcctggctgagcggaaatttcggctacgttgcccattctgactgggtcggcatggacgatatttcgccgtggatggggctggcggtgatcgccgcggaagatcagaaattccctgaacactggggttttgacgtggccgccatcgaaaaagccatctcccacaacgaacgtaacgagaaccgcattcgcggcgcgtcgaccctttcccaacagacggcaaagaatctgtttctgtgggacgggcggagctggctgcgtaaagggctggaagcgggcttaaccctgggcatggaaacggtatggagtaaacgccgcatcctgacggtttacctgaatattgcggagtttggcgacggagtgtttggcgttgaagcggcggcacaacgttattttcataagccagctagccgtctgacgatgtcggaagccgcgctgctggcggctgtgctgcccaatccgctgcgctttaaggctgatgcgccctcaggttacgtgcacagtcgacaggcgtggatcatgcgtcagatgcgtcagctgggcggtgaaggctttatgcgcgaccagggactgtatcagtaatcttccccctctccggcaaggcggggggacttatcagtcttcgtcaaacccggcattaaacagcgcgatcaccgccgccagcgcctcttcttcctgcgggccggtggcttcgatctcaatctgacggcctttcgccgaatccagcatcagcagcgcgatcacgctgttcgcttctgcttctgtcccttcttcattgcgcagcagaacttctgcgtcgaagccctgcatcagttcaaacagtttcatcgccgggcgggcgtgcatgcccagcttgttagtgatttcaacggtttgctttacggtcatgatttgcgtttttccagcgtacgatggcgggattgcacatttttgccgcgcgaacggaagtaatccgccagctgttcagcgatatacaccgaacggtgcttgccgccggtacaaccaatggcaaccgttaggtagctgcggttattggtttccagcatcggcaaccacagttccagatagctgcgcgtctgatagataaagttatgcacttcagtatggcgatcgagaaacgccgccacgggcttatccaggccggtcatcggacgcagtttgggatcccagtgcgggttcggcagaaagcgcacatcaaacacgtagtcagcatcaataggaatgccgtgcttgaagccaaaggactcaaagaccatcgtcagctcacgctcgcgtttgcccagcagacgcgtacgcagcatttcggccagttcgtgcaccgacatttccgaggtatcgacgatcagatcggcgcgggagcgcagcggctccagcagatcgctctcttcgtcgatggcgctttccagcgacaggtttttactggacagcggatgcagacgacgggtatcgctgtaacgacggatcagcgtattgcggtcggcatcaagaaacagcagttgcggagaaaacgcatcgggcaggttgttcatcgcctgttcgaagatctccggcgattccggcatattacgcacatcaatgctcaccgccgccgaaatctgacggtcagcaagcgagcgcgccagttctggcagcagcacgacgggcaggttatcgacgcagtagaagcccatgtcttccagcgctcgcagggcgacagatttccccgatcccgaacgaccactgacgatcatcagtaccatgtaccctttctcctccggacaacaaagacgaaggccatttcctggttaagcatcatcccgggagccttctgtttccgtgatgatttgataaagttcttcatcgctttgcgcgctgcgcagacggcgacaaatggttttatccgccaggcggcgggcgactaaagagagcgtatgcagatgcgttttggtctggtcggccggcaccagcagcgcaaacagcaaatccaccggctggttgtcgatagcatcaaaggcgatcggcgtttccagctgcacaaagacgcccacagcgcgcagcgtatcttcctccagcttaccgtgggggatcgcgataccgttgccgataccggtgctgcccattttctcacgcgtcaaaatcgcctcgaataccacctgcggcggtaagcttagctgtttggcggccagttcactgatgatttccagcgcacgttttttgctctggcagtgaacgccgctgcgggtacattcctggttaaggacattgctcaattgaagagctgaatcgttgttcatcataatttcacctaagcgctaacggtacaaagggcccgttgtgtctcacaacaggccgtcctgcacccgttaactgcccggacaattagtgttgtttcagtttatctttatgtttagtgagctgccgtgaaagtttatcaattaaaccatcaatggcggcatacatatcctgcccttccgcactggcgtggatctctccgccgttgacatgcagggtggcgtcggcgatatgcgtcaccttttccaccttcagaacaatgtagacctgattgatcctgtcaaaaaattgctccagcttggcaaattttgtctgtaaaaattcgcgcaagggctcagtaatctcgacgttatgtcctgtgatattgagctgcatagtgtcttccttatcggttgagtcagaccagctgtttacgctggttagacggcggaatggataaagactctcgatacttcgcaacagtgcggcgcgctaccatgataccctggtcggacagcagggtagttagcttactgtcactcagtggtttcgcagggttttctgcggctatcagtttcttcaccagcgcgcgaatggcggtggacgatgcttcgccgccgctgtcggtattcacatggctggagaagaaatatttgagctcaaaaatgccccgtgggctgtgcaggtacttctgggtagtcacacgtgaaatggtcgattcgtgcatctcgacggcctgggcaatgtcggccagcaccatcggtttcatatattcttcgcctttatcaaaaaaggcctgctgctgctcaacgatacagcggctgacgcgcagcagcgtgtcgttacggctttccagacttttgatcagccatttggcatcctgcaaattactgcggataaactggctgtccgcgtcattacgcgatccgccgcacatggcggcatagtgctgattgatttgcaggcggggaatgctgtcggaattaagctcgacagtccagcgcccctgatgcttacgtaccagcacgtcagggataacatattcgggttcgcccgtctggatcgactggccgggtcgcggatcgagcgactggatcagattgacggcttcttttagcacatcttctttcagccgcgttacgcgcatcagagatcggaaatcatggttcgccagcagatcaagatgatcgctgatgatcaactgcgcttcgtcgcgccagggcgtgtctttgctaaattgcgacagctggatcagcaggcagtcacgcagatcgcgggcggcaacgccgatcggatcaaaacgctgtacgcgcttgagcaccgcctcgacctcatccagcccgatctcctcatcgcccatgctttcaagaatatcgtccagcgagacggtgagataaccggtgtcatcaacggcgtcgacgatggaggtggcaatggcgcgatcggtatccgagaagggggtcagttccacctgccacatcaggtaatcctgcagggactgggtggtttcaccctgataaaccggcagttcatcatcctgataatcgacaccgttacccgaaggcgtaccggcggtgtagatctcgtcccagctggcatccagcggcagctcgtcgggcatctctttctgttcaagggcgtcgacggcgtccaggttttcggtgtcctgtgtcggttgggcgtctatctcatcgtgaagatcggtttgctccagcaacgggttgctttccagcgccagctgaagctcttgctgaagttccagcgtagacaattgcaacagacggatggcctgctgcaattgtggcgtcatggccagttgttggctgagccgtaattgcaaaccttgcttcatattcagagcagtcttctccgcttaaaccctttattttctctaccctatcagagtctgaagccttccccaagatatacgcgcttaacctgttcgtcttcaaggatttgctgcggcgtaccatgggcaatcaggtgcccctggctgacgatataagcccgctcacacacggccagggtttcgcggacgttatggtcggtaatcagcacaccgaggccgctgtcgcgcaggtgctcgataatacgtttgatgtcgataaccgaaattggatccacgcccgcaaaaggttcatccagcagaataaatttcggatccgcggccagcgcgcgggcgatttccacacggcggcgttcaccgcctgacaacgcctggccgaggttatcgcgcaggtgttcaatgtggaactcttccatcagctcattggcgcgatcttcacgctgttgcgaggtcagatcgtcacggatttgcagcaccgccatcaggttatcgaacacgctcagacgacggaaaatcgacgcttcctgcggcagatagccgatgccgcgacgagcgcgggcgtgcagcggcagcagactgatgtcttcatcatcaatgataatgttgcccgcatcgcgcggcacgatgcctaccaccatgtaaaaggtggtggttttacccgccccgttagggcctaacagaccgacaatttcaccggatttaacggtgaggctgacgtcttccaccacgcggcggcctttgtaagctttagcgagattttttgcagttaaagttgccataacggatcagttactctttttttgtgccggagccggggttgcgcttttgtcctgcagttgcgacggcaccagaacggtggtgacgcgcttacctttctcgctgtaagcctgcattttctgctctttcaccagataggtaattttgtcgcctttgatgttgctgtcgagctgctcaaggaaggcatcgccggtcagcaccacgaagtcattttgcagttcatagtgcaactgagaggcatggccttttaccggcttgccgctatcctgcatctggtagaaagtggctggcttgccgaagccgtcaatcacttctttaccttcttcgccgccgggacgcgtcaccaccactttatcggcattgattttgatggtgccctgggtgacgacaacgttgccggtgaaggtcacgacgttgccctgcatgtctaacgattgctgatcggattcaatgtgaatgggctgatcggtatcaccggtcagcgcaaacgcgggaatgctggcggccagaagcgtactggcaagcataaggttaaggctgagtttgtttgttttgaatttcatatgaggttctaaccttttcaatcagctcggcgtttttgctgcgtaagttgccgcgcattttcaggccgctggaattaaatgtcgtaccgtacaacgtaaccagatcgtttgacgtcacatcctgagtgatcaggttaatctgggcgttatccgtggtgattttacgcagttgagcatcagcggtcagggcgttgacctcaacgtgtccataaagataaagcatccggtcatcggtcagtttggccttatctgccttaattgaccatgtaggaattttgtctttgtcgaaagtcgtcaacaccggctgcgtgaaccacgacagcgcctggtcggaaaaatattcaacatgctgcgcgatcaggcggtaattcagcgccccttccgggctgtaaaccaccgtgtccgtgtgctcgctgcggtaggtcggctcattggtgtttgccaccacctgctctgtgtcgtctctgtctgccagattaatgccaatcagcaccagtattaccagcgacagcagaatgataacccaacgtctggttttactcatattgattgccctgtggctgcttcaagtttgccctgcgccagtaacagcagatcgcagacttcccggacggctccgcggccgccattaatgtaggtcacgtaatcggcacgcgggatcagcatcgggtgcgcatcagcgaccgccacgctcagacccacgtccgccatcaccggccagtcaatgagatcgtcgccaatataggccacttcatcggctgataccgccagatcggaaagcagctgtttaaacgcaatgcgtttatcggactgcccctgatacagatgcgtaatgccgagcgtaacgcagcgatcttctaacagtttagccttacggcccgtaattatcgccacctcaataccggaggtgagggcgcaacgaatgccataaccatcacggacgttaaacgcctttaactcttcgccgttgttgcccataaaaatcagtccatccgacatgacaccatccacgtcgaggatcagcaggcggattttctccgcctttgccatcacttgcgcgctgacgggaccgtagcaggttgcaagtgaagcaccagcgttactcattctttttatccttattacactacgcctgcgcgcagtagatcatgcatatgtaccacacccagcaactggtcgccatcggcaaccataaccacggtgatgtggcgggactgcatcaggttgagcgcgtcgaccgccagcaccccggaacgtacgcgaataccgccgggagtcatgacgtcagcaatgccgagattgcggacatccgcgcccatatcgaatacgcggcgtaagtcgccgtcggtgaaaataccttcgattttcatcaaatcgtcgcagatgaccgtcatgcccagatttttgcgtgtgatctccagcagcgcatcgcgcagcgtggcgtctttgctgacgtgggggatctcatcgccggtgtgcatgatgtcattcacccgcagcagcagtttacggccaagggcgccgcccggatgggaaagcgcgaaatcttccgccgtaaagccgcgggcctttaacagcgccaccgccagcgcatcgcccatcaccagcgccgcggtggtgctggaggtcggtgccagccccagcgggcaggcttcgcgcggtactttaacgcataaatgaatgtctgccgcccgcgccatactgctttccgggcggctggtcatgcagatcagcggcacctgcaaacgctttaataccgggattagcgccaggatctcgttggattcgccggaattcgacagggcgatgacaatatcctgcggcgcgaccatccccagatcgccgtgcgccgcttcgccgggatgcacgaagaacgacggggtgccggtgctggcgaaagtcgccgccattttgcgggcgatatgacccgatttgcccatgcccatcaccacgattttaccggcgcagtagaacattttttcgcaggcttcgctgaagtcctgattaatgtactgatcgagatgtgccaggccttcacgttcaatatccaggacatccttacctgcctgctgaaagtcaaagcccggcggcaaatctatttgcgacatattcagttcccattaaccggtaaaaaaaggcgacagccagtagagcatcgccatccaaaggataaagccgccgatcaacagcgcgcccgcgcctttacccgtctgacgccgtggacgccagcacaacagggcgaaaatcacgctgaccaccagcattaccccataatcacggctgaacgcgagcgggttaaacgcgccgggggcaataagcgccggcaggcccagcacgatagctaaattgaaaatattggaaccaataatgttcccgatggcgatgtcatcttcgcctttgcgggcgcccgcaatcgccgtcgccagttccggtaagctggtgccaatggcgatgacggtcagcccgatggtcagctcgctcatggcaaagaagttcgccagcacggtggcgttatcgatcaccatgcgggtggccatcggcatgatgatcagcgccacgcctaaccacaaaaaggccaccgacaggctgccttcgcggggcaactcggcgatctgctcgcgggtcaggctgtcattgccctgacgttcggcgaggcggcctattttcacaataaacagcagccatgcaaccgccagtaatagcaggaagatcccgtccagacgggtcaggctgccgtcatagagcacgctgcctgccagcaggctcatgattaacattagcggcaattcgcgacgcagaatatcagaatgtacggtaaaaggatggagcagggcggcaaggcctaagatcaacagaatgttgacgatgttggatccgatcgccgtgccgatcgccagatcgatctgcccgtgcatagaagcggcggcggaaacgatgatttcaggcagcgaggtgccgatactgactaccgtaaggccgatgacaagcggcgggatccccagactgcggcaaaggatagatgcggcaaacaccagacgatcggcactgtagaccaccaaaagtaaaccaattattaacagcgccgtggctaaaagcatctaaagtcctttcttcaggtataatcatcggcccgctaccacgatcgtctggcaggattgggatcgtaaaaccaatgatttcctaattttgactttatgcggcttaaaagtaaaacaaatgccagctttcgctaaccacagcgagtaatattctgtaaaaatgttgggttcagggtgcgacaacgcgaaatgcttacccctaacaaggctaaaaggatcagtaaatgagccagactgtggcgaatttagtcgatgtccgaggcgtcagcttctcacggggcagccggaccatcttcgacaatatttcgctgacggtcccgcgcggaaagatcaccgcgatcatgggtccgtcagggatcggtaagacaacgctgcttcgcctcattggcggtcagatcccgccggatgccggtgagatcttatttgatggcgaaaacgtgccggagatgtcccgcaccaggctgtacaccgtgcgcaaaagaatgagcatgctgtttcagtccggggcgctgttcaccgatatgaccgtttttgataacgtcgcctatccgttgcgtgaacatacgcctttgcctgcgcccttgctgaaaagcacggtgatgatgaagctggaagccgtcgggcttcgcggcgcggctaaactgatgccgtctgaactgtcgggcggcatggcgcgtcgcgcggcgctggcgcgggccatcgcgctggaacccgatctgatcatgtttgatgagccttttgtcggccaggatcccatcaccatgggcgtgctggtaaagctgatttcagaactgaacagtacgctgggcgtcacctgtatcgtcgtctcccatgacgtaccggaagtgctgagcatcgcggattacgcctatattgtggcggacaaaaaaatcgttgcccatggcagcgcgcaaggattgcaggagaatgccgatccccgggtgcgtcagttcctggatggcattgcggatgggccggtacctttccgttttcctgctggcgattatcttcacgatttattaggaacagggagttaatccactcatgctgttaaattcactggcttccctcggacagcgcggcatcagtatgctcgccacgttcgggcgcgccgggttgatgttattcaatgcgctggtcggtaaacccgagtttcgcaagcatgcgccgctgctggttcgccagctttataacgtgggcgtgctgtcgatgctgatcatcatcgtgtccggtttttttatcggcatggtgctggggttgcagggctacctggtgctgaccacgtatagcgcggaaaccagtctcggtatgctggtgtccctttcgctgctgcgtgaactcgggccggtcgtcgccgcgctgctgttcgctggcagggccggttctgcgctgaccgctgaaatcgggctgatgcgcgccaccgaacagctttctagtatggaaatgatggccgtcgatccgctgcggcgggtgatttcaccgcgcttctgggcgggggtgatctcgctgccgttgctgacgattattttcgtcgccgtcggcatctggggcggttcgctggtgggcgtgaactggaaaggcattgatgccggcttcttctggtcagcaatgcaaaacgccgtcgacctgcgtctggatctggttaactgtctgattaagagtgtggtgttcgccatttcggtaacctggattgcattattcaatggttatgatgcaattccgacctcagcagggattagccgggctactacacgtaccgttgtgcactcatcgttgaccgttcttggcctcgattttgtgctcaccgcactgatgtttgggaattgagtgatgcaaacgaaaaaaagtgaaatttgggttggcgtgtttttgctgatcgccatgctggcggcgctgtttgtttgtctgaaagcggcggatgtgacctctttgcgcagtgaaccgacgtaccgtatttatgccactttcgataacatcggcggcttaaaaatgaactccccggtgcgtatcggcggcgttgtcgttggacgggtcgcggatattacccttgaccagaaaacctatctgccccgcgtgtcgctggatattgaagagcgctacaaccagatcccggacaccagctcgctggcgatccgcacctctggcttgctgggcgagcaatatctggcattaaacgtcggctttgacgacccggagctggggtcttctatgcttaaagaaggcagtacgatccaggacaccaaatcggccatggtgcttgaggatctgatcggacaattcctttacaacagcaaaggaaacgataataagccatcagaggatgcgccaacgccggatgccgctaatactgatgcaacggcacctgctggcccgacgattcattgaggagaattaacgcatgtttaaacgacttttaatggtagcaatgctggtgattgccccgctgactgccgccactgcggcggatcagagcaatccttacaatatgatgcaggaagcggcgaaaaagacctttgatcgcctcaaaaacgaacagtcgcaaatccgttccaatccggattacctgcgtcagatcgtcgatcaggagctgctgccctatgtgcaggtaaaatatgccggcgcgctggtgctgggtcgctactacaaagaggctaccccagcgcaacgtgacgcctactttgctgcgttccgtgaatatctgaagcaggcctatggccaggcgctggcgatgtaccacggtcagagctatcagattgccccggaaaaaccgctgggcgatgcgactatcgtgccgatccgcgtcaccatcatcgatcccaacggtcgtccgccggtgcgtctggatttccagtggcgtaaaaacagccaatccggtaactggcaggcatatgacatgatcgccgaaggcgtcagcatgatcaccaccaaacagaacgagtggagcgatctgctgcgtactaaaggtattgatggcctgaccgcgcagttgcagtcgatctctcgtcagaagatcaccctgcaagagaacaaataatggcgcagcatctcagctggacacgtgacggcgagcgccttgcattacagggcgagcttgatcaggacgtgcttaacccgctctgggatgcgcgagctgaggcgctgcagggcgtgagcgtcatcgatctcaccgcgcttacgcgggtggataccgctggcgtcgccctgctggtgcacttcatcgccctggtcaaaaaacagggcagggcggtgaaactggaaggcgtcagcgataacgtcctgacattagcgcaactttataatttgcctgccgacgccctgcctcactaatattttcagtacgttactacccgtagcctcgcgagattttttagcgaggctttttgcttatttaagacagcgccactttcctctaagatgttggactgttttcattctcggacaatagtagatcccatggaaaatcatgaaattcagagcgtgctgatcaatgcactctcactccaggaagcccacgtcaccggcgatggcagtcactttcaggttattgctgtgggtgaaatttttgacggcatgagccgggtcaagaagcagcaagctgtttatggcccgctgatggaatacattgcggacaaccgcatccatgccgtctcgatcaaagcgtataccccggctgaatgggcgcgcgatcgtaaacttaacggtttttgagctgccggttacgcaccgtcagcatttgtgaattcttaacagagaacagatgaatggataagtttcgtgtacaggggccaacgcggcttcagggcgaagtgacaatttccggcgcgaaaaacgcggccctgccaattcttttcgccgctttgctggccgaagagcctgttgaaatccgtaacgttccgaaactgaaagatattgataccaccatgaagctgctcagccagctgggcatgaaagtggatcgcaacggctccgtgtggatcgatgcccgtgacgtcaatatcttctgcgcgccttacgatctggtgaaaaccatgcgcgcttctatctgggcgcttggcccgctggtggcgcgttttggtcagggtcaggtttccctgccgggcggctgtgcgattggcgcgcgcccggttgacctgcacatcagcggccttgagcagctgggcgcgcagatcaaactggaagaaggttacgttaaagcgtctgtggatggccgcctgaagggtgcgcatatcgtgatggacaaggtcagcgttggtgcgaccgtcaccatcatgtccgccgctaccctggcagaaggcaccaccattatcgaaaacgcggcccgtgagccggagatcgtcgatacggcgaacttcctcaatacgctgggcgcgaagatcaccggcatgggtaccgacaagatcaccatcgaaggcgttgaacgtcttggcggcggcgtctacagcgtgctgcctgaccgtatcgaaaccggtactttcctggtggcggcagccatttccggcggcaaaattgtttgtcataaagcgcagccggatacgctggatgcggtactggcgaaactgcgtgaagcgggtgccgatatcgaagtgggcgaagactggatcagcctcgacatgcacggcaaacgtccgaaagcggttaacgtgcgtaccgcgccgcacccggctttcccgactgacatgcaggcgcagttcacgctgctgaacctggtggcggaagggacgggcgtgatcatcgaaacgatcttcgaaaaccgtttcatgcacattcctgagctgatccgtatgggcgcgcacgccgagatcgaaagcaacaccgcgatctgccatggtgtggaaaccctgtcgggcgcgcaggtgatggcgaccgatttgcgtgcgtccgcaagcctggtactggcgggttgtatcgcagagggcaccaccatcgtcgaccgtatttatcatatcgaccgtggttacgagcgtattgaagacaaactgcgtgcgctcggtgcgaacattgagcgcataaaaggcgaataagctaagcggtaatgcaaccccctgtacgcagggggttgttgcattgtagatggcgtacagccgctatttatgcttctgctggcgcatcatgctggtgcgatcgataaactcatgggtgaccggatcgtggtaacgcgacggccagataatccagggatccgtgtccagcgccttcgcaatgatccattcccctttcggccatgagcgcgtcagcgcatttgccagcgtcgatgaacttagcccgttccggcgcgactccgcggccagcgacgtccctttcttacgcaatccggcgatgatatcggcaggatgccagtcgataaatttattttccatcactcctccctgcggttgaattatgtgcggcttatcctgatgcgccgcagcaattcactatactccttgcgacgtgttgttctaaaaagttcatgtaaacgaaagtgcaattcagaatttattaaggtcgaaatagcaggatataagcgcttatcgggaaggtagtgaaaacttataagaacttattagaatctttccgcgcatgacgcggaaagatatcggcaggattaacgatcgcgctgaacggcgatgtgggcgaggccaataagcgcatcgcgccacggcgtatcaggcagtacctgcaaggcatgaatggccttgtcggcttcttcttcggcgcgacgacgcgtccattccagcgaaccgcaatcggccatggcttccagaaccggctctaaaagatgccgtccgttgccctgttcgatggcctcgcggatcatctgcgcctgttgcggcgtaccgttacgcattgcgtgcaacagcggcagggtcggtttaccttcgttgagatcgtcgccgacgtttttgcctaaggtttccccgtcggcgctgtaatcaagcagatcgtcaatgagctggaacgcggtgcccagatagcggccgtaatcctgaagccctttttcctgcgcggcgctgcagtccgcgagaatgccggagcactgcgcggccgcttcaaacaggcgcgcggttttgctgtaaatcacccgcatgtagttttcttcggtgatgttcggatcgttaacgttcatcagttgcagcacttcgccttcggcaatgacgtttaccgcttccgacattacctccagcaccttcagcgagcctaagctggtcatcatctggaaggagcgcgtatagataaaatcgcccaccagcacgctggcagcattgccaaaagccgcgttagccgtggctttgccgcggcgcatatctgactcgtctaccacgtcatcatgcagcagcgtggcagtgtggataaattcgattaatgctgcgagggtgatgtgcgcatttccgtcatagccaatagcccgtgcggcaagcaccgcgatcatcggacggatgcgtttaccgccgccgctgacgatgtagtaacccaactggttaatcaactggacatcggagttgagctgttgaaggatagtcgcattcacacccgccatatcttgcgcggttaactcattgattttttctaaattcatcgctaatgccgggcttaaagtcctgtttaccacatatcaaaatgggataacgaagggttacgggttagaatagtatcgtcgattgtactgaaaaaacccgccagataaacgttaccatacacgttgtgttttttttcttcgcggattgatgatcactcttgtcaaagcttcgcgttttgcgtaatattcgcgccctattgtgaatatttatagcgcactctgaatcacacaaaaggtgcgcggaagcggagttttttatgtacgcggttttccaaagtggtggtaaacaacaccgagtaagcgaaggtcagaccattcgcctggaaaagctggacatcgcaactggcgaaactatcgagttcgctgaagttctgatgatcgcaaacggtgaagaagtcaaaatcggcgttcctttcgttgatggcggcgttatcaaagctgaaatcgttgctcacggtcgtggcgagaaaattaagattgttaagtttcgtcgtcgtaaacactaccgtaagcagcaaggccatcgtcagtggttcactgatgttaaaatcactggcatcagcgcttaagactaggggagcagatttaaatggcacacaaaaaggctggcggctcaactcgtaacggtcgcgattcagaagctaaacgtctgggcgtaaaacgctttggcggagaagcagtactggcaggtagcatcatcgttcgtcaacgtggtactaaattccacgctggcagcaacgttggttgtggccgtgaccacactctgttcgctttgactgacggtaaagttaagttcgaagttaaaggcccgaaaaaccgtaagttcatcagcatcgttgctgaataagtttttcgcgtcccggtaacggatgaaagccccgcaacacgttgcggggctttttacattcgacgtccggaaaaatctcttgtagggaaaacgggcaatgaagcagcaggcaggcattggaattcttttggcgctgacgacagccatgtgctggggtgcattgccaatcgcaatgaagcaggtgctggaagtgatggaaccaccaactatcgtgttctatcgctttttaatggcagctattggtcttggcctgattctggccgttaaaggcaaactgccgccgatgcgcatttttcggcagccccgctggttggtgctgcttgccattgctaccgggggcttattcgggaatttcattctcttcagctcttctctacaatatttgaccccaacggcatcacaggtgattggacagctctcaccggtgggcatgatggtcgccagcgtgttcattcttaaagagaagatgcgcggcacacagatcataggggcgataatgctgctttgcggactggtgatgtttttcaacaccagcctggtggagatcttcacccgcctgaccgattacacctggggtgtgatcttcggcgtgggagcggcaacggtctgggtaagctatggcgtcgcgcaaaaagtattattgcgtcgtctggcctcacagcagatcctctttttgctgtacactttatgtacaatagccttgttgccgctggcgaaaccggccatgatcgccgaactcagccaatggcaactggcgtgcctggtgttttgcgggctgaatacgctggtcggttatggcgcgctggcggaagccatggcgcgctggcaggcggcgcaggtgagcgcgttaatcacgttgacgccgctgtttacactgttgttttcagatttattatcacaggcctggcccgatgtcttcgccagaccgatgttaaaccttttaggttatctcggtgcgtttgtcgtggttgcgggcgcgatgtattccgccataggccatcgcctgtggggacgtctgcgcaagcgtgaagtggttgtcactttaccccgctcaggcgaatgagtaacggagagtaaaatgaagtttgttgatgaagcgacgatcctggtcgtggcaggtgatggcggtaacggttgtgtaagcttccgccgtgaaaaatatattccccgtggcggccctgacggcggcgacggtggtgacggtggcgatgtctggctggaagcggacgaaaacctgaatacccttatcgattaccgctttgaaaaatctttccgcgctgagcgtggtcagaatggtcaaagccgtgactgtaccggtaagcgcggtaaagacacctgcgttaaggtgccgatcggtacgcgtgttatcgatcagggcaccggcgaaaccatgggcgacatgaccaaacacggtcagcgtctgatggtggctaaaggcggctggcacgggctgggtaacacccgtttcaaatcgtccgtcaaccgtacgccgcgtcagaagaccatgggtacgcctggcgaaaagcgtgacattcagctggagctgatgctgctggctgacgtggggatgctggggatgccgaacgccggtaaatccacctttatccgcgctgtctctgcggcgaagccgaaagtcgcggattatccgtttaccaccctggtgccaagccttggcgtggtgcgtatggataacgagaagagctttgtggtggcagacatccctggccttatcgaaggggcggcggaaggcgccggtctgggtattcgcttcctgaaacaccttgagcgttgccgcgtactgcttcacctcatcgacatcgatccgatcgatggttccgatccggcggaaaacgcgcgcatcatcactggcgagctggaaaaatacagtgaaaatctggccagtaagccgcgctggctggtctttaacaagatcgacatgatggacaaagcgcaggccgaagaaaaagcgaaagctatcgccgaagctctgggctgggaagataagtattacctgatttccgccgccacccagcagggcgttaaagacctgtgctgggatgtgatgaccttcatcatcgagaacccaatcgttcacgctgaagaagagaagcagccagagaaagtcgaattcatgtgggatgattatcatcgccagcagctggaagaagcggaagctgaagaagacgacgaagactgggatgacgactgggatgaagaagacgacgaaggcgttgagttcatctacaagcgttaatccagactaacgctctgccagccaaaagcccggtacgcataacgcgaccgggctttttgtttagttgttctggtaaatatctttgtacagacggctttcaaaccgcaccagcggaatgcggcggttacgctgatcggcaggctcaacggcatagccggacagatactgcacgaacgccatccgctgaccgctggcggtggtaataaagcccgccagattgtagacgccctgcagagagccggtcttcgccgatactttaccatccacgcctgcggcatgcagacccgcgcggtactgcaacgagccgtcgtagcccgccagcggcagcatcgagataaagttaagttcggtatcatgctgagcaatatattgcagcacctgcatcatggtggccggagatatcaggttgtgacgcgacaggccagagccatccaccacaatgctgttccccaaatcgacgcccgcctgctggcggaggatctgccgtaccgcgtcagcgccggcgcgccaggtgccgggcacgccaaagcgcgcatggccgatagtgcggaacaccgtgtcggcgatcatattgtcggattttttcagcatgatcttcagcagatcgtgcaggggagccgactgcttgctggcgatcaccgtgcccggttcattgaccagcgtctgacgcagcagggtgccgctataggtgatccccgcctgtttcagttcatctttgataatggcgccggcatagcttgcgccgtcctgaatggcgaacgccagcggcagggggtcagcacgctgcgtcatacagcctgtcagcgtgaaacggtttaagtcacccggaaccacatccagctcgcagtactggccctcagcgctgccacgggccagcgtacgcacctggctgaacatgttcacggggtaataggaggcgacgcggataaatgccagatcattggctttctgagcgctgtagagggaaaccgagaaacagttacggtcgacaatggcggccgctggcggggcactgaagcattgcgtcatgtcattccatggccagccgggcgctttgtcatgactggcgaaaatggaggtatcgataagcacgttgcccgcgatttcacgcacgcctgcttttttcagaaccgccaccatattgcgaatatcctgacgttttaacgtcggatcgcccccaaagcgcgccgtcagatcgccttgtaagacgccgttttcaatcggggctttgctttcaagcgtggtcgtgaagcggtaatcagggccaagttgcagcagagcggcaagggcggtgatcactttctgcgtactggcgggaagggccatttgctggctgtgataatcaatatccggtgcctgagcgccaatcttctgcaccatcagggcgaggttcgcgccggcaggcaactgattgatgtactcgtcgacattcgccgcctgaacattcatcgctatactggtggtcaatccgatgacaaatctggaaaatcgcataatctcgcgctaacaacctggaaacaggccgtcatactacggtgcatcgcccttgaaagtaaacgatgacccatagtgaacttcgcggtaaaatgcgtatcaaattgaaaaattgcttctgacctggggctgtgactccgggtcagttttcttttgcttctggtccgggaacccgatgaaaaacgggcgggcttagctgccggggcgggacaccgctccctacaggaatgttcaagaggtataacaaatgcaagctattccgatgaccttacgcggtgccgaaaaactgcgcgaagagctggattttctcaagtccgtacgccgtcctgaaattatcgcggccatcgccgatgcccgtgaacatggcgatctgaaagaaaacgccgagtaccatgccgcccgtgaacagcagggcttctgcgaaggccgtatcgctgatatcgaagcgaagctgtccaacgcgcaggtgatcgacattgctaaaatcccgaacaacgggcgtgtgatttttggctgtacggtaaccgtgctgaacctcgacaacgacgaagagcagacctaccgcatcgtgggcgatgacgaggctgattttaagcagaatctgatttctgtgaattcgcctatcgcccgtggcctggtgggtaaagagcaggacgatgtcgtggtcatcaagacgccgggcggcgaagttgaattcgaaatcatcaaagtggaatatctttgattaggttacaatgtgtaatatgttgacgcattgtaaagaaaagaaaaaggccgcgaagcggccttttaacaacactcagagcgtggcattttgctcgtctgcttttagaaaacccctcgttttacacagattttgtgtttaactcaggatattcttaacgtggcagcgcgattttacggtctgctgttgggcgatacagaaccagcgttttaccgatgacctgtacattacaggcgccggtttcacgaacaatggcttccacgatcaacgtcttggtttcgcggtcttcagtcgcgattttaaccttgataagctcatggtgttgtaacgcatgttcaatctcggccagtaccccttcggtcagaccattgttgccaagctgtactactggcttgagcggatgtgccagacctttcaggtgctgtttttgtttagtactcagattcatcgtatatttttgcttacgttgggattgaaaacggttcattctaccgccatctcccttatatcgccaaattgccgtgtggaaatttacaccatcggctcacgatgaacccagatggaatgttaaatgacaggtaaaaagcgttctgccagctccagtcgctggcttcaggaacactttagcgataaatatgttcaagcggcacagaaaaaagggttacgttcccgtgcctggtttaaacttgatgaaatacagcaaagtgacaaactttttaagccggggatgacagttgttgaccttggcgcagcacctggcggctggtcacagtatgtggtaacacagattggtggcaaaggccgtatcatcgcatgtgatcttttacctatggatcctatcgttggtgtggacttccttcagggcgattttcgtgatgaattagtcgtgaaagcgttacttgatagggtaggcgacagtaaagtccaggtcgtaatgtcagatatggcaccgaacatgagcggaacacccgcggtggatattccccgcgccatgtatttggtggagctggcattgcagatgtgtcgggacgtattggcacctggcggcagttttgtagtgaaggtgtttcagggcgaaggcttcgatgagtatctaagggaaattcgctccctgtttacgaaggttaaagttcgtaagccggactcttctcgtgcgcgttcacgtgaagtgtacattgtagcgaccgggcgaaaatcataacccgttgatttcagacaaccgtttgaatgaggctggatatggcgtatcctgacgctgtttttaacacagttgtaatatgaggttaatcccttgagtgacatggcgaaaaacctaatactctggctggtcattgccgtcgtgctgatgtcagtattccagagctttgggcccagcgagtctaatggccgtaaggtggattactctaccttcctgcaagaggtcaatcaggaccaggttcgcgaagcgcgtatcaacggacgtgagatcaacgttaccaagaaagatagtaaccgttacacgacttacatcccggtaaacgacccgaaactgcttgataacctgctgacgaaaaacgtcaaagtggttggcgagccgccggaagaaccgagcctgctggcttctatctttatttcctggttcccgatgctgttgctgattggggtctggatattctttatgcgtcagatgcagggcggcggtggcaaaggcgccatgtcgttcggcaagagcaaggcgcgtatgctcactgaagatcagattaaaaccacgtttgctgatgtcgcaggttgcgatgaagcgaaagaagaagtggcggaactggttgagtacctgcgtgaaccgagccgtttccagaaactgggcggtaaaattccaaaaggcgtgctgatggtggggccgccgggtaccggtaaaacgctgctggcgaaagctatcgccggtgaagcgaaagtgccgttctttacgatttccggttcggacttcgtggaaatgttcgttggtgtcggtgcctctcgtgtgcgtgacatgttcgaacaggccaaaaaagctgcaccgtgcatcatctttatcgatgaaatcgacgccgtaggccgtcagcgtggcgcaggtctgggtggtggtcacgacgaacgtgagcagaccctgaaccagatgctggttgagatggatggcttcgaaggtaacgaaggcattatcgttatcgccgcgactaaccgtccggacgtgcttgacccggcgctgctgcgtccaggccgtttcgaccgtcaggttgtggtcggtctgccggatgtacgtggtcgtgagcagatcctgaaagtgcatatgcgtcgcgtaccgctgtcaccggatattgacgcggcaatcattgcccgcggcacgcctggcttctcgggcgcggatctggcgaacctggtgaacgaagcggcactgtttgctgcccgtggtaacaaacgcgtcgtgtcgatggtggaattcgagaaagcgaaagacaaaatcatgatgggtgcggaacgtcgctctatggtgatgacggaagcgcaaaaagaatccacggcgtatcacgaagcaggccatgcgatcatcggacgtctggtgccggaacacgatccggtgcataaagtgacgatcatcccgcgcggccgtgcgctgggcgtgaccttcttcctgcctgaaggtgacgcgatcagcgccagccgtcagaagctggaaagccagatttcgacgctgtacggcggtcgtctggcagaagaaatcatctacggtgcggagcatgtttccaccggtgcgtcgaacgacattaaagtcgcgactaacctggcgcgtaacatggtcacccagtggggcttctccgataaactcggtccgctgctgtacgcagaagaagaaggcgaagtgttccttggccgttctgtcgcaaaagcgaagcatatgtctgatgaaacggcacgtatcatcgaccaggaagtcaaagcgctgattgagcgtaactacaatcgcgcccgtgagatcctgaatgcgaatatggatattctgcatgcgatgaaagatgcgctcatgaaatatgagaccatcgacgcaccgcagatcgatgacctgatggctcgccgcgatgtgcgtccgccagcgggttgggaagatccaggcgcgtccaacaactctgacaacaacggcaccccgcgtgcgccgcgtccggtcgatgaaccgcgtacgccgaatccgggcaataccatgtcagagcagctgggcgacaaataagtttttcgcactgatgctgtgtctgtattacttcaaaccctggagcttgctccggggttttttattattctgttcacctcgttatacaagggatgatttatgaaacgctttgctcaggggtcagtgctcgacctgtcgcatccacatgttatgggcattctgaacgttaccccggattccttttctgacggtggcgcgcataacacgctgatcgaggcagtaaagcacgctaacctgatgatcaatgcgggggcgaccattatcgacgtcggcggcgaatcgacgcgtccgggggcgctggatgtcagcgtagatgaagagttgtcccgcgtggtgccggtggttgaagcgctggcgcagcgttttgaagtgtggatctcggttgatacctcaaagccggaagtgatccgcgaaatcgcccgcgtcggcgcgcatcttatcaatgacatccgttccctgacggagccgggggcgctggaggcggcggcggaaaccgggctgccggtctgtctgatgcatatgcagggcgaccccaaaaccatgcaggatgcgccaaaatacgatgatgttattactgacgtaacgcgcttttttatcgacaatattgcacgttgcgaacaggcgggcatcgcaaaagagaaattgttgctcgacccgggattcggtttcggtaagaatctgtcccacaactatgcgctgctcgcccgcttatctgaattccatcagtttgatctaccgttgctggtgggaatgtcgcgcaaatcgatgattggccagctactgaatgtagggccttctgaacgcctcagcggcagcctggcgtgcgcggtgatcgcggcaatgcagggcgcgcatattattcgtgtccatgacgtaaaagaaacggtagaggctatgcgagtggtcgaagccacactgtcagcgaagggaaagaaacgctatgagtgaacgtaaatattttggaacagatggtattcgtggtcgtgtaggcgatgcgccaattacgccggatttcgttcttaaactcggctgggccgccggtaaagtcctggcgcgccatggctcgcgtaaaatcattatcggtaaagatacgcgcatttccggctacatgctggaatctgcgctggaagccgggctatcagcggcgggcatttccgcctcttttaccggaccaatgccgacgcctgctgtcgcgtacctgacgcggaccttccgcgcggaagcgggaattgtgatttccgcctcccataacccgttctacgataacggtattaaattcttctccatcgacggcaccaaactgccggatgacgtggaagaggcgattgaagccgaactggaaaaagagatcacctgcgtggattcggcgctgctgggtaaagccagccgtatcgtcgatgccgccgggcgttacattgaattctgcaaaggcaccttcccgaacgaactcagccttaagggtttgaaaattgtggttgactgcgcgcacggcgcaacctaccacatcgcgccaaacgtcttccgcgagctgggcgctcacgtcatcaccattggctgtgagccgaacggcgtgaacatcaacgaggaagtaggggcaacggacgttcgtacgttgcaggcccgcgtggtggccgaaaaagccgatatcggtatcgccttcgacggtgacggtgaccgcgtgatcatggtggatcatgaaggtaacaaggttgatggcgatcagatcctctatatcatcgcccgtgaaggtcttcgtcagggtcagctgcgcggtggcgcagtcggcacgctgatgagcaatatggggctggagctggcgctgaaacagctcggcattccgtttgcgcgcgcaaaagtgggcgaccgctacgtgctggaaaaacttcaggagaaaggctggcgcattggtgcggaaaactccggccatattctgctgctggacaaaaccactaccggcgacggtatcgtggctggccttcaggttgtggcggcgatggtgcgtaaccatatgaccctgcacgacctgtgcagcggtatgaagctgttcccgcaaatcctcattaacgtacgctttacggctggcaacggcgatccgctggaagatgaaaccgtgaaagcggtcaccgcagaagtggaagcggcgctgggcaatcgcggccgcgtgttgctgcgtaaatccggtaccgagccgttgatccgtgtgatggtggaaggcgaagacgaagcgcaggttacggcattcgctaaccgcattgcggacgcagtgaaagcggtataattaccgtgttaagtgcctaaaaaaggcggcacttgccgcctttaaatcgcacaggcttcgcgtttttgctgtttttttccgcacttgatacaatgcgttgaaattgcccttgcgcaggtcatgcgctttggttagtattcacacccgcttcagtgggaaacgaaataacgtcccgcttttatggtcagaagctaatgttacgcggcagccccgcaaggaacaggttgattatgtacgaagctcttttggtagttttccttattgtggcgattggccttgtcggtctgattatgctgcaacaaggtaaaggcgctgatatgggagcctcctttggcgcaggctcatctgctacgctgttcggttcaagtggttctggtaacttcatgacccgcatgacagctgtactgggtaccctgttcttcatcatcagcctggtgttgggtaacattaacagcaacaaaaccagtaaaggaagcgagtgggaaaatctgagcgcgccagcgaaatctgagcaaactcagccagctgctccggctaagccgaccagcgatatcccgcagtaatagcagtatcagtgctgaggtggtggaattggtagacacgctaccttgaggtggtagtgccctaacgggcttgtgggttcgagtcccatcctcagtaccaatattccgaaagaaagacatcgaaagatgtcttttttttcgtctgtaatttacctggcagacaccgacaaacaaaaaaagggcgcttatcgcgccctttgttctcactgaaaaggttatttcttctcgctgtgttccaggctgtccatctgcggcaggcccgtactggcggaggcggtaagcaggccagactgcgcataaccaaacagcttctcgcgggtatcggcgatatccagattacgcatggtcagctgcccgatacggtcgtcaggtgagaatacggaatcccctttttccatggtcagacgctctgctttataggtcaggttgtcagacacagtattcaggatcgagtagtcattgccgcgacgcagttcaagcgtcacttcgccggtaatagcgcttgccacccagcgttgcagcgcgtcacgcagcatcagcgcctgagagtcaaaccagcggccctgatacagcagacgacccagctgacggccatgggcgtgatactgctcaatggtatcttcgttatgaataccggtcagcaaacgctcataggcaatgtgcagcaaggccatgcccggggcttcgtaaatgccacggcttttcgcttcaatgatacggttttcaatctgatcgctcatccccagaccgtgacggccgccgatacggttcgcttccagcatcagttccacatcatcgctgaaggtctggccgttgagcgcaacagggtggccctgttcaaaacggatggtgacttcttccgccgggatcttaacgttctcatcccagaattttacgcccatgatcgggttaacgattttcacgctggagttcaggaattccagatccttcgcttcgtgcgttgcgcccagcatattggaatcggtggagtaggctttttccacggacattttgtaatcgaatccgcaggcgatcatgaattcggacatttcctgacggccgcccagctcatcaataaagtcggtatccagccacggtttatagattttcagctcagcgttagtcagcagaccgtagcggtagaaacgttcgatatcgttgcctttataggtactgccgtcgccccagatattcacaccgtcttctttcatggcggcgaccagcatggttccggtcacagcacggcccagcggcgtggtgttgaagtaggtcaacccaccggtggtgttatgaaacgcgccacactggatagcggcaatgccttcggcgaccagctgcttacggcagtcgatcaggcgggcattctcggcaccatactcttttgcacggcgtggaatcgcgtcatagtcatcctcgtccggttgacccaagtttgctgtataggcgtaaggaacggcacctttctggcgcatccacagcagggccgcgctggtgtcgagaccaccggagaatgcaataccaatacgttgtccaaccggaagatgcttgagaatcgtcgtcataaaataaatccctgcttaatatactgatggtgagagacttaacagccacgccatgatgtgttgtcaccggaagatgataccgcttagcttctcatcattaatgcatttttatgcaaaattagtgagttttcatttaaacatcttttggcgacgatcgaaagcgaagagtgacagaatagttaaaaaatcgctggcgtagccgccgggcgggcgtttaacgatgtgtctttcgcgtcaatacctgcttcattgcgtattccacgctatgcaaatctgtgcgtggcggcaggtaaacccctctgcctggcgttcattctgcggtttccggcacgcgcgcgtagttttccttgcaatgaacaaaatcaattgattataatactcgtcttatcagtagttcccggtgtttacacctgtcttaacttgcatttaatgcatgatcggcgtagtatttgccacgtttcaggcgcggggtggagcagcctggtagctcgtcgggctcataacccgaaggtcgtcggttcaaatccggcccccgcaaccactttcccttagtgttctttttcaaatatactgtgaagacgtttgagccttcctctttttggatttgaaaaaaatacttctggaaggttctccaggccgcagttgcggctatagggttcagttatctaaagccccgatttatcggggttttttgttatctgactacagaataactgggcttagcgccctttttttatgtcttgggggtgggtttgtccacattagagcaaaaattaacagagatgatcactgcaccggttgaggctctgggctatgaactggtcggcatcgaatttgtacgcggtcgcacatctacgctgcgcatctatattgatagtgataatggcatcaatgttgatgattgtgctgatgtcagccaccaggtgagcgcagtaatggacgttgaagatcctattaccgtcgcttacaacctggaagtctcctcaccgggtctcgatcgtcctttattcaccgccgagcactacgcgcgttatatcggcgaagaagcaacgctggtactgcgtatggcggtacaaaaccgtcgcaagtggcagggtgtaattaagggtgttgacggtgaaatgatcaccgttacggtcgacggtaaagatgaagtgttcgctttaagcaatatccagaaagcgaacctggtcccccacttttaacagtctggattgaggtgaaaggcccccaatgaacaaagaaattttggctgttgttgaagcagtttccaacgaaaaatcgttgccgcgtgagaaaatttttgaagcgctggaaagtgctctggcgacagcaaccaagaaaaaatacgagcaagagatcgacgttcgcgtagaaatcgatcgcaaaagcggcgacttcgacaccttccgtcgctgggttatcgttgaagaagtgacgcagccgacccgtgaaatcacgctggaagctgcacgttacgaagatgaaagcctgaatgtgggtgattacgttgaagaccagattgaatctgtcacctttgaccgcattactacacaaacagcgaaacaggttatcgtacagaaagtacgtgaagctgaacgcgcgatggttgtggatcagttccgcgagcacgaaggtgagatcatcaccggcgtggtgaaaaaagtgaaccgtgacaacatctctctggatctgggcagcaatgctgaagctgtgatcctgcgtgaagatatgctgccgcgtgaaaacttccgtccaggcgaccgtattcgtggcgtgctttatgccgtgcgtccggaagcgcgtggtgcgcagctgttcgtgacgcgttccaaaccggaaatgctgattgaactgttccgcattgaagtgccagaaattggcgaagaagttattgaaatcaaagccgctgctcgcgatccaggttctcgtgcgaaaatcgctgtgaaaaccaacgacaagcgtatcgatccggtaggtgcctgcgtaggtatgcgcggtgcccgtgtccaggcggtgtctaccgaactgggcggtgagcgtatcgatatcgtgctgtgggatgataatccggcgcagttcgttatcaacgcgatggcgccggcggatgtcgcctccatcgtggtggacgaagataagcacaccatggatatcgcggtagaagcgggtaacctggcgcaggcgattggccgtaatggtcagaacgtgcgccttgcttctcaactgagcggctgggaactcaacgtcatgaccgttgatgatcttcagtctaagcatcaggcggaagcccatgcagcgatcgacacctttactaagtatctcgacattgacgaagattttgccactgtactggtagaagaaggtttctcgacgctggaagaactggcctatgtgccaatgaaagagctgctggaaattgacggtcttgatgaagcgaccgtcgaagccttgcgcgatcgcgctaagaacgcactgaccaccctggcgctggcacaggaagaaagcctcggtaataataaaccggctgatgacctgctgagccttgaagggttggatcgcgaaatggcgtttaaactggctgctcgtggtgtttgtacgctggaagacctcgccgaccagggcatcgatgacctgagtgatattgaaggtctgaccgacgagaaagcgggcgagctgattatggccgcacgtaatatttgctggttcggtgacgaagcgtaataaactgtagcaggaaggaacagcatgacagatgtaaccgtaaaagcgctggccgctgagattcagacctccgtggaccgcctggtacagcaatttgctgatgcagggatcccgaagtcatctgacgactcagtgacagcacaagaaaaacagacattgttagcgcacctgaaccgtgaacatggttcagcgcctgacaagctgacgttgcagcgcaaaacgcgcagcacactgaacatccctggcaccggcggtaaaagcaaatcggtgcagatcgaagtccgcaaaaaacgcacctttgtaaaacgcgatccgcaagaggctgaacgtctcgccgcggaagaagaggcgaagcgcgaagcggaagagaaggccagtcgtgaagcgcaggaagctgctaagcgtgaagccgaggaaaaagccaagcgtgacgcacaagagaaagcgaaacgtgaagccgaagaaaaagcgaaacgcgaatccgctaacccggtgaaacgcgaagctgcggaaacgagcaaagtgagcaatcaacaatctgacgaaatgaccaggactgcccaggctgaaaaagcccgtcgtgaagccgaagcgcaagaactcaagcgcaaagctgaagaagaggcacgtcgtaaactggaagaagaagcacgccgcgtggcagaagatgcgcgtcgtatggccgaagaaaacgagaaaaatggtgttaatgtggctgctgaaccggttgaagagtccagtgactatcatgtaaccacttctcaacatgcgcgtcaggcagaagacgacagcgaccgcgaagtagaaggcggccgcagccgtacgcgtactgctaaagcacctcgcccgaaaaaaggcaacaagcattccgaatcgaaagccgatcgcgaagaagcgcgcgctgctgttcgtggcggtaaaggcggcaagcgtaaaggttcttctttacagcagggcttccagaaaccggctcaggcggttaaccgtgacgttatcatcggtgaaaccatcaccgtgggcgaactggctaacaaaatggcagtgaaaggctctcaggtcatcaaagcgatgatgaaactgggcgcaatggccaccatcaaccaggttatcgatcaggaaactgcgcagctggttgcggaagaaatgggccacaaagttatcctgcgtcgtgaaaacgagctggaagaggcggtaatgagcgaccgtgacactggcgctgcggcagaagctcgcgcacctgttgtgaccatcatgggtcacgttgaccacggtaaaacctcgctgctggactacattcgttcaacgaaagtggcctctggcgaagcgggcggcattactcagcacatcggtgcgtaccacgttgaaactgacaacggtatgatcaccttcctggataccccgggtcacgccgcctttacctccatgcgtgctcgtggtgcgcaggcaacggatatcgttgtgctggttgtggcagcggacgatggcgtgatgccgcagactatcgaagcaatccagcacgcgaaagcggcgcaggtgccggtagtggttgcggtgaacaaaattgataagccggaagctgacctggatcgcgttaaaaacgaactgtcccagtacggcgttatgccggaagagtggggcggcgagtctcagttcatccctgtatccgcgaaagccggtaccggtattgatgacctgctgaacgctatcctgctgcaggctgaagttctggaactgaaagcggttcgcaaaggtatggcgagcggcgcggttatcgaatccttcctggataaaggtcgtggtccggtagcaacggttctggtacgtgaaggtacgctgaacaaaggcgacatcgtgctttgtggcttcgaatatggccgtgttcgtgcaatgcgtaacgaactgggtcaggaagttatggaagccggtccgtctattccggttgaaatcctgggtctgtccggtgtgccggcagccggcgatgaagtgaccgttgtacgtgacgagaagaaagcgcgtgaagttgcactgtatcgtcagggcaaattccgtgaagtcaaactggcgcgtcagcagaaatccaaacttgagaacatgttcgctaacatgactgaaggcgaagttcacgaagtgaacgttgttctgaaagctgacgtacagggttctgtagaagcgatttccgattccttactgaaactgtctaccgacgaagtaaaagtaaggatcattggttccggcgtaggtggtatcaccgaaaccgacgcgaccctggctgcggcatccaatgctattctggttggcttcaacgttcgtgctgacgcctctgcgcgtaaagtgatcgaagcggaaagcctggatctgcgttactactccgtcatctaccacctgatcgacgaagtgaaagcagcgatgagcggcatgctgtctccggaactgaaacagcagatcatcggtctggctgaagtgcgtgacgtgttcaaatcaccgaaattcggtgcgatcgcgggctgtatggttaccgaaggcaccatcaaacgtcacaacccgatccgcgttctgcgtgacaacgtggttatctacgaaggcgagctggagtccctgcgccgcttcaaagatgacgttaacgaagttcgtaacggcatggaatgtggtatcggcgtgaagaactacaacgacgttcgcgttggcgatatgatcgaagtgttcgaaatcatcgagatcaagcgtaccatcgcttaatcttcgtaatgcccggtggctgggttgcaggtctgataagcgtagcgccttcaggcctgagagcaccacctggcaactatttcaaaaggggcttttagccccttttttgtctttatctggaggacttattatggcgaaagaatttggccgccctcagcgtgtcgcgcaggagatgcaaaaagagatcgcgcttatcctgcaacgcgaaattaaagatccacgtctgggcatgatgaccaccgtttccggtgtggaaatgtcccgcgacctggcctatgcgaaagtgtttgtgacctttctgaacgacaaagacgaagaagccattaaaggcggcatcaaagcattgcaggacgcctccgggtttatccgttcgctgctgggtaaagccatgcgtctgcgtatcgtgccggaactgaccttcttctacgacaactcgttggtggaaggtatgcgtatgtctaatctggtgaccaacgtggtgcgtcatgacgatgaacgtcgtgtgaacccggacgacaccaaggaggactgatgagtcgtcctcgtcgtcgcggtcgcgatgtgcacggcgtactgttgctggataagccgcaagggatgtccagcaacgacgtgctgcaaaaagtaaaacgtctctataacgcgaatcgcgccgggcatactggcgcgctggatccgctggcgaccggcatgctgccgatttgcctgggagaggcgacaaagttttcccagtatctgctggattcggataagcgttaccgcgtgattgctcgtctggggcagcgcacggatacctccgatgccgatggacagattgttgaagaacgcccgatcaccttcagcgcagagcagcttgctgccgccctggaaaccttccgcggtgatatccagcaaatcccgtccatgtattcggctctgaagtatcaggggaagaagctttacgagtacgcgcgccagggtattgatgtgccccgtgaggctcgtccgattaccgtttacgagctgctgtttatccgccacgaaggggatgagctggagctggaagtacactgctcgaaaggcacctatatccgcaccattgtggacgatctcggtgaaaagctcggctgcggcgcacatgtgattttcctgcgccgtctggcggtgagcaagtacccggttgatcgcatggtgacgcttgagcaattgcagtcgctggttgagcaggccggtgagcaggatattcctgccgctcagttgcttgatcctctgctgatgccaatggacagtccggcagcggacttcccggtcgtgaatattcctgccgtcagcgccgcctatttcaggaacggccagcccgttcgcgcggcacaagcgccgacagaaggcctggtgcgcgtgacggaagggccagagtcggtatttatcggcatggcagaaatcgacgatcagggccgcgtggcgccacgccgcctggtggttgagtacccggcgtaatccattgcagttaccttgcgataacagggtactgcgagtagaatattgccgcttaacgtcaggttagatgtttaacatcttccggcgttaaacctggggttgctgaattagagatcggcaccctttcattcttttaattttggagtttaaaatgtctctaagcgttgaagctaaagcaaaaatcgtttccgagtttggtcgtggcgagaacgacagcggttctaccgaagttcaggttgccctgctgactgctcagatcaaccacctgcagggtcactttgcagagcacaaaaaagatcaccacagccgtcgtggtctgctgcgcatggtttctcagcgtcgtaaactgctcgactacctgaaacgtaaagatgttgcacgctacaccgcgctgatcgagcgtctgggtctgcgtcgctaagtctggcgagtttcacagaaaggggccttaacggccccttttttcaaccagacggcagcaattcgacctaaactattgtattgttgctatgaatgatcttcgttgcagaggttcgcgcggctaatgagaggctttacccggtttgggttagggttgtcattagtcgcgaggatgcacagaagatcgggtattaacgtcagcacacccaatggtgtgctgtcattcattaagaaaggataaaattttgcttaatccgatcattcgtaaattccagtacggtcaacataccgtaacgctggagaccggcatgatggcgcgtcaggcaactgcagctgttatggtaagcatggacgacaccgcggtattcgttaccgttgtgggtcagaaaaaagcgaagccgggccaggacttcttcccgctgacggttaactatcaggagcgtacttatgctgctggtaaaatcccgggtggcttcttccgtcgtgaaggccgtccaagcgaaggcgaaacgctgatcgcgcgtctgattgaccgcccggttcgtccgctgttcccggaaggcttcgttaacgaagtacaggttatcgccaccgtagtttccgttaacccgcaggttaacccggacatcgtggcaatgatcggcgcatccgctgcgctgtctctgtccggtatcccgttcaacggcccaatcggcgcggcgcgtgtaggttacatcaatgaccagtacgtactgaacccgacccaggaagagctgaaagcaagcaaactggatctggtggttgccggtaccgaaggtgcagtgctgatggttgaatccgaagctgaactgctgagcgaagaccagatgctgggcgccgtggtatttggccacgaacagcagcagatcgtgatccagaacatcaacgacctggtgaaagaagccggtaaaccgcgttgggactggcagccagaagcggctaacgaagccctgaatgcacgtgttgctgcgctggctgaatcccgtctgagcgatgcttaccgcatcaccgacaaacaggagcgttacacgcaggttgatgctatcaaagctgaaactgtggctgcgctgctggctgaagatgaaaccctggacgccaacgaactgggcgacatcctgcacgctatcgagaaaaacgttgttcgtagccgcgtactggcaggcgagccgcgtattgatggccgtgaaaaagacatgatccgtggtctggacgtgcgtaccggcgtgctgccgcgtacccacggttccgcactcttcacccgtggcgaaactcaggcgctggttactgcgaccctgggcaccacccgtgacgcgcagaacatcgacgaactgatgggcgagcgcactgacagcttcctgttccactataacttccctccgtactccgttggcgagacgggcatggtaggttcaccgaagcgtcgtgaaatcggtcacggtcgtctggcgaagcgtggcgtgctggcagtaatgcctgacgctgagaaattcccgtacaccgtacgtgtggtttctgaaatcaccgaatccaacggttcttcttccatggcgtccgtatgcggtgcttctctggcgctgatggatgcgggtgtgccgatcaaagccgccgttgcgggtatcgcaatgggtctggtgaaagaaggcgacaacttcgttgtgctgtctgacatcctcggcgacgaagaccacctgggcgatatggacttcaaagtagcgggttcccgcgacggtatctctgcgctgcagatggatatcaaaattgaaggtatcaccaaagagatcatgcaggttgcgctgaaccaggctaaaggtgcgcgtctgcacattctgggcgtgatggaacaggcaatcaacgcgccgcgtggcgatatttcacagttcgcgccgcgtattcacaccatcaagatcaatccggacaagatcaaagacgtcatcggtaaaggtggctctgtgatccgtgcgctgaccgaagaaaccggcaccaccatcgaaatcgaagatgacggcaccgtgaaaatcgcagcgaccgacggcgagaaagcgaaatacgctatccgtcgtatcgaagagatcaccgcagaaatcgaagtgggtcgcgtctacaatggtaaagtgacccgtatcgttgactttggcgcgttcgttgccatcggcggcggtaaagaaggtctggtgcacatttctcagatcgctgacaagcgtgtagagaaagtgaccgactatctgcagatgggtcaggaagtcccggttaaagttctggaagtcgatcgccagggccgcgtccgtctgagcattaaagaagcgactgaacaatctcagcctgctgaagcggcacaagcgccggcagcagaacaaggcgagtaaggttgctgtttagctctccgtcgttgacggagagttttcattccgggcaggatgctgtgtttgcagccgggggacaggatgtccatctaattgttgtcttcgggagtgggaaatgaagccttttttgcgctggtgtttcgttgcgacagctttaacgctggcaggatgcagcaactctgcctggcgtaagagcgaagtcctggcggtgccattgcaaccgactttgcagcaagaagtgattctggcgcgcatggaacaaattcttgccagtcgggctttaaccgatgatgaacgcgcacagcttttatatgagcgcggagtgttgtatgatagtctcggtctgagggcactggcgcgaaatgatttttcacaagcactggccatccgacccgatatgcctgaagtattcaattacttaggcatttacttaacgcaagcgggcaattttgacgccgcttatgaagcgtttgattctgtacttgagcttgatccaacttacaactacgcgcacttgaatcgcggtatcgctctgtattacggcggtcgtgacaagttagcgcaagatgatctgctggcgttttatcaagacgatcccaatgatcctttccgtagcctgtggctttacatcgccgagcgtaagcttgacgaaaagcaggccaaagaagcactaagacagcgcttcgagaaatcggatagagagcaatggggatggaacattgtcgagttctacctcggtgacattaacgaagcaacgttaatggatcgcctgaaggcggacgcaacggataacacctcgctcgctgagcatctcagtgaaaccaacttctatttaggtaagttctacctaagtctgggggaaaaggacagcgctacggcactgttcaagttagcggtcgctaacaacgtacacaactacgttgagcatcgttatgcattgttggaattatcgctcttgggccaggagcaagatgacctggcagaatcggaccagcaatagctgacgaacaacgatcagcccaccaacttttttagtaaagtcatcatcctgacgggtgagggcgtttttgttcgttaatcaactaaatttgagccggttcacacttttcaatgaaaattgcagatcaatttcacgatgagttacgtagactggccgccatcaatgaggcacatgtactacatgactgataccatcgaaaccactttttctgatcttgggctgaatgcctccatccttcaggccctgaacgatctgggttacgaaaagccatctccaatccaggcagagtgtatcccacatctgctgggtggccgcgatgttctgggtatggcccagaccggtagcggcaaaaccgcagcgttctctttaccgctgctgcacaacctcgatcctgagctgaaagcgccacagattctggtgctggccccgacccgcgaactggcggttcaggttgctgaagccatgacggacttctctaaacatatgcacggcgtaaacgtggttgccctttacggcggccagcgttatgacgtgcagctgcgcgccctgcgtcagggcccacaaattgttgtgggtaccccgggtcgcctgctcgatcacttaaaacgcggtacgctgaacctgtccaacctgaaaggtctggtactggacgaagcggatgaaatgctgcgtatgggcttcatcgaagacgttgaaaccatcatggctgagatcccggctgaacatcagaccgcgctgttctccgccaccatgccggaagcgatccgtcgcattacccgccgctttatgaaagagccgcaggaagtgcgcattcagtccagcgtaaccactcgcccggacatcagccagagctactggtctgtatacggtatgcgtaaaaacgaagcgctggtgcgtttcctggaagcagaagactttgacgcggcgatcatcttcgtgcgtaccaaaaatgcgaccctggaagtggctgaagcgctggagcgcagcggttataacagcgccgcgctgaacggtgacatgaaccaggcgctgcgtgagcagaccctggagcgtctgaaagatggtcgtctggacatcctgattgcgaccgacgttgcggcccgtggcctggacgttgagcgtatcagcctggttgttaactacgacatcccgatggactccgagtcttacgtgcaccgtatcggccgtaccggtcgtgcaggtcgtgcaggtcgcgcactgctgttcgttgagaaccgcgagcgtcgtctgctgcgtaacatcgaacgcaccatgaagctgaccattccggaagttgaactgccgaacgcagaactgctgggcaaacgccgtctggaaaaattcgccgctaaagttcagcagcagctggaaagcagcgatctggatctctaccgtggtctgctggcgaaaatccagccttccgctgacgaagagctggatatcgaaaccctggctgccgcactgctgaaaatggcacagggcgagcgtccgctgatcctgcctccagatgcgcctatgcgtccgaagcgtgaattccgtgagcgtgacgagcgtttcgaacgccgtggcgaccgtaatgaccgtggtccgcgtcctgagcgtggcggtgaagatcgtccgcgtcgtgaacgtcgtgacgcaggcgaaatggaactgtatcgcattgaagtgggccgtgatgatggtgttgaagttcgtcacatcgttggcgcgatcgctaacgaaggcgacatcagcagccgttacatcggtaatatcaagctgttcggtactcactccaccatcgagctgccgaaaggtatgccgggcgaagtcctgcaacactttacccgtacgcgtatcctgaacaagccgatgaatatgcaactgctgggtgatgcacagccgcacgaacgtcgcggtggcgatcgtcctgccggcgaacgtcgcttcggtggcggtgagcgtcgcgaaggtggccgtggcccacgtcgtgaaggcgcagcgccaggcgctggccgtttcagcggcgaacgtcgtgaaggcagccgtggtccgcgtcgcgaagacggtgccgcatccggtcgtcgtcgcttcggtgatgcataatcgcgtaacgcattacgctttactgtaaagtaaaagttccagccccgatcttaacaatcggggctttttttatctgctttgtactcatgtactggtacaatgctggcgcgatgcttcactgaccgaagctgttataacaccggagataaaacggatggcgacgttaacgaccacacacaccactccttcgctgctggctggcgttgtgattattgcgggtacaatcattggcgcaggcatgttttccctgccggtggtgatgtccggcgcgtggttcttctggtcactggcggcgctgatcttcacctggttctgtatgctgcattccgggctgatgatccttgaagcgaacctcaactatcgtattggatccagcttcgacaccattacccgcgatctgctcggcaggcgctggaacgccatcaacggcatttccatcgcctttgtgctctatatcctgacctacgcctacatttccgcgagcggctcgatcctgcatcatacttttagcgaaatgtcgctaaacgttccggcacggctggcgggatttggttttgcgctgctggtggcgtttattgtctggctgtcgacccgcgcggtcagccgtatgaccgccattgtgctgggcgccaaagtcatcaccttctttctgaccttcggcagcctgctggggcacgtccagcccgccacgctgtttaatgtggccgaaagcaacgcctcctatacgccttatctgctgatgacgctgccgttttgcctcgcctcttttggctaccacggtaacgtccccagcctgatgaagttttacggcaaagatccgcgcaccatcacccgttgtatcgtgctgggctcgttactggcgctggggctgtacgcggtctggttgctggggacgatgggcaatattccgcgcccggcctttatcgccattgccgcgcagggcggaaatatcgatgtgctggtgcaggcgttaagcggcgtgctgaatagccgcagcctggatttgctgctgctggtgttttctaactttgccgttgccagctcgttcctgggcgtaacgctggggctgtttgattatctcgcggatctgtttgggtttgacgacagcgcggcagggcggcttaaaaccgcggcgctgaccttcctgccgccggtggtgggcggtttactgtggccgaacggttttctgtatgcgattggctatgccggactggcagcaacgatctgggcggcaattgttccggcgctgctggcgcgcaaatcccgcaaacgctttggcagcccgcggtttcgcgtctggggaggcaaaccgatgattgccctgatcctgattttcggcgtcggcaacgcggtggtgcatctgttgtcgagttttaatctgttgccggtgtatcagtagtcaatctcttgccggatggcggctgcgccttatccggcctacaaaattaatgttgtaggcccggtaagcgtagcgccaccgggcaaaacctggaaatgtaggcccggtaagcgtagcgccaccgggcaggccagaactatcccaacagctcttctttcacctgcatcgccaggtcaaaagaatgcagccgcgcctgatgatcgaaaatctggccgttcaccatcatctcatccgcctgggtttctcgcaggatcgactccagcccgtggcggactttcgctttatcccccaccagcgacatgctcagcgcctgctgcacaccgtatttttctgacggcgaccagaagtgatcgatgttatcaatcggcggcggcagctgcgaggtctcgccccggcgcagcttcacaaacgcctgctgcatggaggtgaacaggaattctgcatcgcggttactgtcggcggccacgatattgatgcacaccatcgcatacggcttctcaaggcgcgccgacggcttaaagttgctgcggtacaggtgcagcgcctggaacagcatatccggcgcaaagtgcgacgcgaacgcaaagggcaggccaagctgggcggcgaggtgggcgctgtagagactggagccgagcagccagacgggaattttctcgccgtagccgggcaccgggcgcacatgcggattcggatcgcgggcgtcaaaccagtccaccagctctgccacatcgcgcaggaagttatcgacatcgccgctcatatgacggcgcagcgccatcatggtgcgctgatcgctgcccggcgcacgccccagacccagatcgattcggcccggatagagcgtattgagcgtaccgaactgctcggcgatcaccagcggcgagtggttcggcagcatcacgccgccggagccgaggtgcagagtgttagtatttgccgccagataaccaatcagcacggacgtcgccgcgctggcgatgccggtcatattatgatgttcagccagccagaagcgatgatagccacgtttttcagcgagacgggccagatccagagagtgttcgaaggcgtctttcgcagaagcgccctgcgggatcggtgcgagatcgagcaccgaaaaaagcggggatgtatcggtcataatgcgctcactttgttacaggctaattctttaatactgcattaaagcgtagctaaagctgttaacaaagtgagctatctgtgtaattgcgcggcaggctacaccagttccagaccagctacccgcttccagtaaccattgcagtcactgtgtgccgccagcggcagcggggcgccaccgttagcgttggcgcgaaaggccgccagcatatccagcgtttcagcgcccatcggcgacaggcgcacaatgtccaccagcccgttcatcgaagtctgttcgttgccgaggttatagacatagccgctcatcgtctgaataccgtttaacacgaacacctgctggttttcctgcgacagcacattgcgccccgtcgggtatttgatgcagcaggtttcgcactcatctttgggccggtcttccgagcgggcggtaaagcagcgcgctgaataggccagcggcagatgaccatagctcagcacttccacttcaaactgattgcggatccccagctcatcgcactggttcagcagattaaccagccagtcgcgggacagctccaccggcatacaccagcgcaccatgccctgtttgtgcaacaggcgcagcgtcacggcgttatagcagttcagcgcatgaccggcgacgaacggcagttttcgctcggcgcacatattcaccacgccgagatcgctggcctccagcataaactcgccgttctccacatagcgcttcagttcattaagttcagatgaggcctgcaccagcgccagcgtcgacagcaccacctgcttgccgctttgcgccagcgctttcgccatatccagccagtcacctgatttggtggcgcggcgcttgctgcataccgcctcgccaagataaataatatcggcttcgctttcagcggcctgctgatagaaattttccagcgtctcttttgaccagtagtagagcaccggtcctaatgcatatttcattggtttctcactgccatttacggtgataggcgcccagcgtcgtttgcgtgccttccgacatcgcccccagcgtatccatccatgccgcctgcggcgcgtaggcgtccggtgcggccatgcatttatcgatagcctgacgccagaccttagccacctggctgacgtacgccgggctgcgctgacgaccttcaattttcaccgaggcgatattggccgccagcagctccggcaacagctccagcgtgttcagactggtcggctcttccagcgcgtgatagcgctcgccatccaccagatagcgccccttgcacagcgtcggataaccggcgttttccccttcctgatagcggtcgatcagcacatcgttcaggcgtgattccagcccctgcggcgtctgttgccagcgcacaaagcgcgccggtgaacaggcgcccacggtattgggcgattcgccggtcaggtaagaggataaatagcagcgtccttccgccataatgcacaggctgccgaaggcgaacacctccagcggaaccggcgtggtgcgggagagctgtttcacctgatggatcgacagcacgcgcggcagcaccacgcgcgccacgtcaaaatggcggtgataaaaacgaatggcttcgtcattggtggccgaggcctgtaccgagacatggcgttcaatatggggataacgttccgcggcgtattcgagcatcgccagatcggcgaggatcagcgcatccgcgccgagctgcgccgccatgtccaccgcccgctgccagcgctgatagccgtcagggtgggcgaaagtgttaatggcgatgtgcaattttttgccgtgctggtggacatagctcactgcttcctggagctttttctccgtaaagttaagtccggcaaaatggcgggcgttagtatcatctttcaggccgatatagacggcgtcggctccgttctcgatggccgcctttagcgccggaagatttccggccgggcagagcaactccataatatatcctgcggttcaacgggccagcctgacccggacgcacctgagaggtgcaaaaattgttaacgaactgggattttagttaacccttcggcgacaatttttgatttgaggcagttaatcgcgtattgatgacaccaataatgctgtatttcttcgtcgtaattgttgatttgcgccgctatgtcgtttgtatgatgtggcagaataagcgcactaatcatttcagggagtaatgcttgtgttggataaactgcgctcacgtctcgttctcgcgggtccgtctttactgagtgtgcctgtgaagctcgcgcctttcgcccttaaacgccaggtactggaacaggtcctgcgctggcagtttcagcaggcgctggcggatggagaacttgagtttctcgaaggacgctggttaagtatcgaggtgcgtgacattggccttcagtggttcacctccgttgagaacggtcagttaatcgtgcgccagtctgccaatgccgacgtcagcttcagcgcggatgccagcgatctgctgatgatcgcggcccgcaagcaggatccggatacgctgttcttccagcgccgtctggtgattgaaggtgatactgaactgggtctgtacgtcaaaaacctgatggacgccattgaacctgagcagatgccgaagccgttacgcgttctgctcatgcaactggcggaatttgttgaagcgggcctgaaaacgccccctgaaactaaacctctttctgtaggtgaaccatgctgattagagttgaaatccccattgatgcgccaggcattgacgcattacttcgtcgcgcttatccgggcgatggcgaagcgggtctggtacatgatctgcgtgaagatggtttgatcacgctgggtctggtggcgacagatgacgaagggcaggtggtgggttatgtcgccttcagcccggtctctgtgcagggtgaggatttgcagtgggtagggcttgcgccgctggccattaacgaagattaccgtgggcagggtctcgcgcggcaactggtgtatgaagggctggattcactcaatgaatttggctatgccgccgtggtagccttaggagatgcggcattctatgaccgcctcggttttgagcgggcggcgcattacgatctgcattgccgctggccgggtacggaaaccgccttccacgtccatcggctggcggatgacgccttcaacggcgtaaccgggctggtggagtatcacgatcatttcaatcgcttttaagcgcaggcatttgcaggctggctaacagcgcttcaaatgaaccatccccgctgacgaggcgctctttctggcgcttcgtcagttgtttgatccggtattcgatccgcaatgcaagcgagcgttcaccaacctgcgccgtaaaggccagccgcagctcgcctttaccccgcagcgcctttgcgcctttgcccgactgatgctggctgaagcggcgggatacgtccgtggtaatgccggtatagagcgaatcatcagcggtgcgaataagataaacagaccagggcgtcattacagcgttcactatgttaaggtgagcgcaccatagcatgaggaagaagtcagatggaatcactcgccgccattaatcgctggctggccagacaacatgtgctgagctggtgtgtcacccgcgacggggaactgtggtgcgcaaacgccttctatctctacgatcccgtaaaagtggcgttctacgtgctgagtgaagatcacacccgccatgcgcagatgaccgggcaaaacgcgccggtggcgggcaccataaacgggcagccgaaaaccgtcgcgctgatccgcggcgtgcagttcaaagggaagatccgccgactgagcgaggaagaaagcgacgtaccgcgcgcgcagtataatcgccgctttccggtggccagagcgttatcggcccccgtctgggagatcctcccggacgagatcaaatttaccgataacaccctgggcttcgggaaaaaacttcactggttgcgcgactcagctgccgagtaagcgcagggcttcgcggttaaaggcgggcagatcgtccggggtacggctggtgacgatctggttattatctatgaccacttcctggtcatagaaatccgcaccggcgtttttcagatcgataacaataggtttcaccgtggtgagcttacgtccgcgtaccacttcggcgctgatcagcagttgcgggccgtgacagatggcaaacacgggtttaccggaatccacaaattcacgggtaaaggtaacaaagcgatcgtcgccgcgcagggtgtccggcgagtgaccgcccggcagtaacagcgcatcgaactcgtcaggtttcacttcatcgatagctttatcgatagtgatgctggcttcccctttcttacctttgaccgttttcccggcttccatctcaatggtgatcacctcatggccggctttacgaaacgcttcggcaggtgacgtaaattctgaatcttcaaactcgtcggttatcaagactgcaatcttcttgcccatatttcctccgctgttttgggttcagacaggtgatttcgccataaatcgttaataatgacgaagagtactgttaagtctggttcagtgacgcgacattgcaaggcggactaatctgcaaaggagatgagatgactcaggtaatgatcaccggcgcgaccggcctggtagggggacacctgctgcgtatgctcaggcagacaccggaaatcaccgccatcgccgcgcccacgcgccgcccgttagcggacgcttacgacgtgtttaatccgcacgatccgcagctcagcgatgcgctggcgcaggtaaaagatccgctggatattgtgttttgctgcctgggcaccacgcgccgcgaggcgggcagcaaagaagccttcattcatgctgattatacgctggtggtggacacggccattaccggccagcgcctgggggcgaaacatatgctggtggtcagcgccacgggcgcgaatcctcattccccctttttctataatcgcgttaagggcgagatggaagaagcgctgaaggcgcagcactggccccggctgaccctggcccgcccgtcgatgctgctcggcgaccgcaataaaaaacgcttcaatgagtcgctgatggcgccattattccgtctgctgccaggaaactggaaatccattgaggcgcgtgatgtggcaaaagccatgctgatcaccgcgctttctccggcgcaggaaggcgtaacggtactggattccgcgcagttacgggaaatcgcccaacgcgcacgggattaatcgtttccaaaagcggttcgcaggcgtagtattttccggcttaataaaacattactcctggaaaatgctatgactggtcagtcttcatctcaggcggttgcccctgtccaatggtggaaacccgcactcttttttctcgtcgttattatcggactctggtatgtgaaatggcagccgtactacagtaaagccttcactgccgccgaaacgcacagcatcggtaaatctattctcggccaggcggccagcagcccgttacaggcggcgctggattacgccatggtctatttccttgccgtctggaaagccgccgtgcttggcgtactgctcggttccctgattcaggtgctgatcccgcgtgactggctgctgcgcaccctcggacagccgcgctttcgcggcacgctcctcggcacgctgttttccctgccgggaatgatgtgctcctgctgtgctgcgccagtgacggcgggtatgcgtcgtcagcaggtttccatgggcggggcgctggcattctggatgggaaacccgttacttaatcccgcgaccctggtatttatgggctttgtgctcggctggcactttgcgttgatccgtctggtggccgggctggtcacggtgatcggggtggcggccgtggtgcagcatctggtgaaagatcgcgcgcagccggttgaaccggtggaagtggcggtcccgcaggcgcagggcggttttatgacccgctggggtaaagcgctctggtcgctgttctggagcaccattccggtgtatatccttgccgtgctggtgttgggagcggcgcgcgtctggctgtttcctcatgcggatggcgcgatcgataactcaatactgtggatcgtcgccatggcgatcgtcggctgtctgttcgttatcccaacggctgccgagatccccattgtgcagaccatgatgctggctggcatgggcaccgcgcctgcgctggcgctgctcatcaccttgccggcggtcagtctgccgtcgctgattatgctgcgtaagtcgttcccggcgaaagctctgtggcttaccggtgcgctggtggcattgtgcgggatgattgtcggcgcgctcgcgctggtgtgagatttgacaccctctcccgacgggagagggttaacatgagtggattatttaataaaggtgaaggccgttgtcacgtgcttcacgccgctcacccggctggcgatatccgccgcagcctgcgcttcacgttcggtcaccagccctaacaggaacacttcgccgttctcggtggtcaccttcacgttcgaagatttcacctgatcgctgcctaacagctgcgaacgaactttggtggtgatccaggtatccgatgatgccgtgcccagcccaatcggctgaccctgacggatctcgttatatacttcggtggtgccttccacgcccatcgcgatctgtttggcgcgtgcggagagcgaactgtccggagactgtcccaccagcaggactttgccctgataagcggtcacgttaatgcgggtgtttttcttaatctgttcgtctttcgacagcgcgctgtttacgcgtacctccagcgtgccgtcatccacttgcgtacccacggtacgcggatccgttgccgctttcgtgcccaccgctgccgttcctacgaccgcagcagctacacatccctgaagcaataatgcggaaataaggactgcgaggggcgaaaatgccttcatgtgtactccttaatcatcctggtgtggaaaaagcgtgttatcgatcagatcgcacaggcagttcaccgtcaacatatgcatttcatgaatacgtgcacttcgatgcgacggtatacgaatttcaacatcctgaggccccagaagcccggccagttccccgccgtcgtagcctgtcagcgcgacaatggtcatatcgcgtgtcactgccgcttccaccgctttcacaatgtcgcggctgttgccgcgggtggagatagccagcagcacatcccccgcatggcccagcgcccgcacctgtttggcataaatttcttcatgccggcgatcgttggcgatcgcagttaagaccacgttatcggtattaagtgcaatggcgggtaaactggggcggtctgtttcgtaacgattgatcatgctggcagcaaaatgctgtgcattggcggcagaggtgccattaccacaacagaggattttgttgccgttgagcagggactgaaccagcgtcatggcagcacgggaaatcgcatccggcaacgcttccgccgccgcaatctgggtttgaatgctttccgtaaagcagactttaattctttcgagcacgataatccctattatttcagcaattatgagtggtcgttaaaggcgtcttgtatccactcaacatcatttccggtgaaggctaccacatcgaaccggcaatccacagtgtcaaaactcccattgtgccgggcaagccacaaacgcgcggtttgcagcaatcgcaactgtttttgccgggtaacgctggccgcagcgccgccgaatgtcgccgttttgcggtagcgaacttcaatgaagaccgtcgtcggcccgtgtttcattatcagatcaatttcgccgccacgcgcatgcacgttggcggcgataaaacgcagtcctttgccttccagccagcgacgcgcgcgtacttcccacgcctcgccggtctgtttacgcgttaaccggccgggacgatctgcccctgttggtatttcagccatgataacttcctgttaatcacacaatcctgagtggcggaaaggtcgccggtgttgccgttaatctcaaagcccggcacctggcgcatttgcgagaaatgattagccagcgcccaggcatccacgcccatggcatacagacgcgccagtgaataatcgttgttcacgctgctgagcgcctgctgcatcagcgccggattgctgcccgccagcatcgggatctcgctgtattgcaggccttccatctcaagacggaaatccggaccggcaatgcctttcgcactgcgggaactggcgtacagcgtggcatggctctggctgccgttgcgcatggcgatcatcggtttgataagcgcaatttcatccggcgttgccagaatataggctgcatcaacattaccgccgccgctgatttgcgcatcgctgggcggcgccggaatggtcaggccgccgatagtgacgctctgctgcgcaggcaggctggcggtcaccgggctgccggtgagcgcgataccggaattgctgttaatgcccatcttcagttctgctgtggaaccaaatttctgttgcagcaccgtaccgccgccgagtttttgccactcatcggcaaaagcgttggtgacgcgatcgccaagcgtactgcgcggcaccagcattaacggcgcgcggtggccctgatcccagatgtggtgcgccgcatcgcgggcttcatcttccggcgacagggcgaagtaacagatattcgcccggctctcgacggtttccggctggttaagggccagcacgttaagcgccgtattgctcttcatcagctcttcgacgttagatttcagcagcggccccaccacaatgctggcgccatcctgctgaacctgggtgaggatctgatccagcggctgcgtggtggtgtcatacacttttagctgcgcgccagggttagcgggcgtgctgaccgctgaaggcggagcggctgctgtttcagtggctgccactggcgcatcagcggacggcgctggcgtagcagcctctgtcggttgtgcttccggctgcggctgatcttcaccgctgatatcgccaacctgcgccgccgacgggctgacgacgtccgcgggcgcgctgctttcttcagtggtggcggcctgcgcaacctgggcaggcgtagccggacctgatacggcagcgacgccgttcttcgccgcttcaaaaccctgctggatggtacggccaaataccgccgcctgaccgttcaacggcagcagcagggcaattttgctggtggaggccggggtaaagttctgcacgttcaccagctgcgacggcagcattttcgcgccagggttttgcggataacgcacctgccagtcgctgatgcccgctttcagcatgttgggatcgttacggttatcaaaccagacgcgttgcagatccagccagccctgcagcacgttttcatcggcattgatcaccagcgcctgcgcctgttccggcgtcatctgcgacagtgcctgccaggtggcgtctatgttggcctgcttttctttcgccgccagcagcggctcctgcgcaatcagcgcccgcaacagcgtcagggaagggcgaccctgctgggcggtaatgcccgcctgccagaatcggctttgctgatttttgtcgagttctgccggatccattttgccgaggagcgcctgcgcgccctggaaatctttctgcgcgactttcatttccgccgccagcaacgcctgctcgcgacgctgcgcgtcactgagttcctgcggcaaccgggcgaacagctcgctcgcctgctgcgttttaccttctttcagcagtgcacgaatggcgagtaattgccagttggtcttgctatcatcggagctttgctgcatctggttcaggtaataacccgaatcagcctgctctgcgccctgcatgtgcgcactgctctgatccggtgattgcgttccgcagcctgcaaaaagcagggcggccagcaccacaggcagacaacgcgtggcttttgaacgaagaaatgttgacggtaccattctgtatccagtgatatttttcaggcaatgctcaatattaaatcggcactacggacgaaacaatgaaacaacgcgaatcagctgagaattctcaaggtcagctttatattgtacccactcctatcgggaatttggctgatattacacaacgtgctctcaccgtgttgcaaagcgttgatttaattgcggctgaagacacgcgtcacacgggattactgctgcaacatttcgccatcagcgcgcggctcttcgccctgcacgatcataatgagcagcaaaaagcggaaaccctggtggcaaagctcaaagaaggccagaacatcgcgctggtttccgatgcgggcacgccgctgattaacgatcccggctaccatctggtgcgcacctgccgcgaagccgggatccgcgtggtgccgctgccggggccgtgcgccgccatcgccgcgttaagcgccgccgggctgccgtcggatcgtttctgctacgaaggattcctgcccgccaaatccaaaggccgccgcgacacgctgaaagcgctggaagcggagccccgcacgttgattttctacgagtccacgcatcgtctgctggatagcctggaagatatttgcgccgtgctgggtgaatcgcgctatgtggtgctggcgcgtgaactgaccaaaacctgggagtcgatccagggcgcgcctgtcggcgagctgctggcctgggtgaaagaggacgaaaaccgccgcaaaggtgaaatggtgctcatcgtcgaagggcataaagcgcaggaagaagatctgccggcggatgccctgcgtaccctggcattgttacaggcggaactgccgctgaaaaaagccgcagcgctggcggctgaaattcatggcgtgaagaaaaacgcgctgtacaaatatgccctggagcagcagggagagtaattctgcaagccgttaaccacttccctgcattttcagggctgtggaggcgaaaaccgcagggccgtcggcgtacagggcggctcgctgcttttaggctggtacggcttaagcccgaagggacagagcgcgaagcggcactttttatctttcggacagggggtgacaaaatcccgtgtattgcccggacaatcggtcttttttaacaggttttgccacagtttcgcgttgtagggcgacgcgtgaataaccgagatgttccgcaattttccatcgacgaacaggcccagttccccggtcgaaaaggcgttcccctgccgcaaaaaataatcccctttacaccacaggatgagcttaagattttttgacgtctgggctatcgagaagtaggtcccggtatccgggctcgccagagaatcaataattttccaggtcataacaccccttgtttttttaatttaagaaagtcgcgaatggcaaacgcgcaatcgtttagtgatgcgctaattcaccgcgctatgcggtatgatttgccttaaggccatcaagaaaattcgcgtctaaaattaacttagtttagatttacgaattcatcaaaaaacttacaaaaggtggtgttttatccggtaggaaaaggggctaacgcccctaagattttgaaggttgctaatgccagactgctttaaaggtgtcggcgcacttactatcagacgataatcatctccatatttttctgccgaaacgctttgatttcttcggctttaatactttcatcggtgataatgcagtcgatctgttcaatcggcagcacctgattaaaaccgcggcgattgaatttggtggcatcaaggacggcgaccaccttatgcgcggcggcagccatcacgccgctgatggagtagccttcgttaaaggtggtgatgccattctgcgtgtcgatgccatcggccccgacgaacatcaaatcagcgctgatgccctgtaatgaacgctccgcgatggtgccatgcatggagtgggttttatggcgcacggtgccgccgcacaccaccagcgtaatatccttgttatccgccagcataaacgcagcgggcagactgttggtgatcaccgtaatattggcgtgttttgtcaacgcttcggcaataagcatggtggtgctgccgctgtccagaataagggtcattccttcctggatcatggcgacggcggcctgggcaatacgctttttcggatcgctggcaagctggtagcgatcctccagcaccacttcctgattatcgggttccgtcagattgctgccgggtcttgctgcaccgccatggaagcgggtcgccagcccctttttttccagcaaacgcaaatctgcgcggattgtcacttctgaaataccaaaggctgacgccagatctaataccagcacgctgccctgcgcattaatcagatcaacgattgcgttccttcgttcaaatgagttcatctttatctgcctgattattaactgaccttagtgtaatcgaagggttatgaaagttgaatgccatttttcgaaaggaaatgtgagccagctcaggttgctggcccgaaagtctaactgaactgcagcagaattttgccctgcatcggcgcgccctgaagcgcttctaccgcctgcgcaaaatgcgccgcatcgccacggtgggcgataagcggcgtcagactgaggcgtttttccgtcagcagacgcgcggcgatttgccactcctcgccaggccagggtccggaatagttcatccagctgccggttatcgtcagctccttacgcaggatctggccaaaaactgacgaggggagcgtgagatcctgatgcagcgtgcctaccagcgccagctgcgcgcgcgatcctgcgatgtcaatcgacagagcgacggtttgcggcgtaccggcggtttccagcagcagctgatcaaactgacaatcggccagcgccgcctggatctgcgccgcgctcatctcccggctgttaaaggtttgcgtcgccccaagtgattttgccagcgccagtttttgcggattaatatcaatggcggttatgcttcgcgcgcccagctctctggcgcactgcatggcaagtaagccgatagtgccagctcccacaatgatgacatttttcccggcgcagccgcccagcagatggaacgcatgcaacccaacggtaatgggctcaataaaagcgccgtcctcaatcggcatgtcagcgggcagggcgaaaaggtttgcgcgcttcaccaccacatattccgcgtggccgccatcgctgcgcgagcccacgaactgatagtgtttacagagcgaaaagtattcccgctcgcactgcggacactgaaagcagggcagcaaaggtacgcaggccaccgcgtcgcctgggtgcaaatccgtgacggctgcgccgcaggagaccacatagccgctaaactcatgcccaagggtgatggggtaataatgcgcaccgtgcgcgaaaatacgcggaatgtctgagccgcacagacccgagctgatgaccttcaccagcacctcgtcttccgcattaatctgaggctgtggacgttcttcaacgcgcacctgtccctcagcatggatgaccactgatttcatacacttctccgaaaatgttatgggggcctcagcccccggagattaggaaacagtttgcgcctgttgcgccgccgcggctttctccgccatcacgaactggcgcgcgcgacgccaggtgagaaacaccccggccagatagatcacgccaatcacggcaaagccgactatgttctgccaggtaaacagctggatcagcagccaggtgaccggcgaaccgccctggtccatggaggccaccataccgcccgccttcagcgcgcctgcgttcgccgccagttgcgtatgcagaccgatagtttgcgtggtgatccacagcgtaatgcccataatgatgacgccggagatcagcgtacggaacaggttgccctgatgaaccgccactgccatagccacaaagaagccaatggtggccagatcgccgaacggcaggacctggttaccgggaaccagcacggcaatcagaatggtcagcggaataaaaatcaggctggcggagaccaccgaggtatgaccaagcagcagcgcgggatccagaccaatcaggaattcctgaccgccaaatttcgcctgtaaacgcttacgggcgtgcttcgcgataggcgtcagaccatccatgataggcttgatgacgcggggcatcagcagcatcaccgccgcggtttttaccgccagttgcagcacgtttttcgcgtcgtagcccgccagcagcccaatcactaagcccatcacaaagccaacggtcaccggttcgccaaagggtccgaagcgcttttgcacatcatcggcgctgaaatggatacggttaagaccggggattttttcgataagcgtgtcgaccagaaccgccaccggaccgagataggccgatgaaccgtggggtatcgcaataccctccaggccaaagaagtcgcgggtatctttcgcaaaccagtcgcccagcttgtaaacaaaggccgcatgcgccaccacgcccagcatgccgatccagtaggagccggtcgccagatgcagcatggcgccggtaaaggtcatgtgccagatgttccagatatcgacgttcaccacgcgggtcatccgcgtcaccagcatcagaatattgacgccaatggcgacaggaatggcgatcagcgcgatctgcgaggcccaggtcatgggtgacgatcccggccagccaatatccaccacatgcaggttgatctggaactgctccgccatggcctttgccgccgggccgatggaatcaagcatcaggccgatcaccagcccgataccgacaaagccgatgccgatatgtaggccggacttaaagcaatccccgagcttcatccccagcaatttcgaaaagaggatgatcaccagcggcagcatcaccgtcggcccaagatcgaggatataacgcatgatttcgctaaacataagcttaccctcgcagaatggtcaggattttttgctgcaacggctcgatgccgacgccggaaacgaaaggcataccgtgaacgacagggatgctgccgaaggttctgtcgacgcgggcggtggtgcagatcaggtgcgccccgtccatgtaagtttcgatttccgttacccggcactgcaccagttcgagcgggatgttattggcctcgcacagctctttgatctcttctgctgccatagtggaggtcgccacagcgccgccacaggcgacgattactttacgtttcatagggtattccttttattatcagtatattaataaggtcagagacagggttcttgctcaagcagcctttgcctgaatagcgacgccagttcagcatccggcgcatgaagcagcgcctccagggtggccgggttttgtagctcgctgaataaccggcgcagcagttttagctgggcgtcggggttttcaacgatcagcgcgatgatcagcgaaacggcaatctcatcgtcgtcatcggcgcgccggaacagcaccgggctgtccgggcggatcaggtaaatggcgggcgatttggcatgtagcgcctcgcagtgagggatagcgacggcatgctgttccagcgcaattcccgtcgggaaggcggcttcccgctccagcaatgcctgcgggtaggtgtcgtgcaccacaccatgggccagcatcgtttcgccaatatgctgcaacgcatgctggcaggagggaaagtcgatgccggttcggacaaagagttggctcatagatcctcttgcagattcagacgatgtcaggtgaacagccatagcggtaagcgcgcagcacatcctggatgcggtcgaggatcagcgcgtgcggtgtggcgttcagttcgttgcgggaaagccgttcaaactgcaccggcatgtactggctgatcaggcccagcggcaacgtgatttcaccaagacctgcgatcagtttttcgacgctctggcgaatgcgcggatgcggccagtagtagcgaatgcgatcggaaaggctgaaatggatatccaccatcgactggctccatgtcgggcggtagtactttttccagtagccaggctcgtcgagcattacctcgtcgatcacctccagcacatggctgcggcgctccggcggaaccagcgcgttttccatctgcgccagcgcaaatatcgcttcgcgcagggcaaaggtcagcgccgggccaactttcagaatggcaaagtgatcttccaccagcgcccggtaagcttcgcgggtctggtaatccgtggagtgcgcctcatagaccagcggcgtggcggcgatccagtcggataactcacgcgccgcctgcggctgataatggatgatttgcgtatggtcgaattcgacgcccggctgcaccaccagggcgatgacgcgctgcatggcgtcctccaggcctgcggcgcggaaggccgcctgatgggtttccagggtggcggcggcatcccttgcgcgggtgacgtggacgctgccaatgctgctggcttcgccgccgggcaccggtacttccgtgccaatcacgtaggtgagctggcgtttttgttccggtgtggccgtggcttcggcggcagcgcacagacgggcggcgcggctggcgacgacggcgggatcgagcgcaacaggatcgtctgcgcaggacatggaagcatcaagatggatcttgctgaagcctgccgcgacgtaggcccggataagctcgacggatttctccatcgcgtcagccgcgttttcgttctgccagcagttggggccaaggtggtcgccgcccagaataatgcgctcgcggggaaagcccactccggcggcgatgttaaacacaaagtcgcgaaaatccgcgggcgtcattccggtatagccgccatattgattgacctgatttgaggtggcctcaatcggtaccttttcctgcgtatacaaatcaaagcgcagtgccgcttcgatcaccagcgggtgggcggagcagaccgagcaaatgcccagtcgttcgcccgctttatggcgcgagataatttctttcattttgtagggtccgtttggttttgtttagtttcgttatcttctgtggctgaggcaaaagtaatgttccgtttctgaagcctgctctcaaagtttgccttcgcagccgcacacgcctatcactttgcgcaccacctctttcatggcggctttcgcaggttgcagatagtggcggggatcgctggcctgcggatgggcctgcaggtagtctttcagggcggcggaaaacgccatttttaactcagtcgccacgttgactttgcagacgccaagcgcgatggcgcggcgaatgtcggcatcaggcaaaccggatgcgccatgcagcaccagcggcacatccacgcactggcggatggcggcaagacggtcaaaatcgagttccggctcatggtcatacaggccatgcgcggtgccgatggccaccgcaagggagtccacgccggtgagttcaacaaaggtttttgcctgctccgggctggtgaaacgcgcatcccggctgtcgacatgcagatcgtcttcctggccgccaagccgccccagctccgcttccacgctggcgtcatagcgatggcagaactgcgtaacgcgctgcgtcagcgccacgttttcactaaagggcagatgagagccgtcgatcatcaccgagcgaatgccagccacgactctggcttcaatatcggcaagggtttcatggtgatcgagatgcatggcgagaggatgatcaagcgcgcgtgccagatccgcggcaatggcgatcaggttgccggtgcccgcatagctgaaggtgcccggcgtaccggcgacaatcagcggcgcgcgcagttcagcggcggtttctgccaccacctgtaaagtctcaaggttatggatattgaaggccggcacggcatagccttcctgctgcgctttggtgagcatggttctggtcgagataagatacatactttctccgttacctttcgaatgatttcattcgaaataaaataaaggtatttgaaagtaatttttgtgatcctgatcgaagggatggattttcgaaacaaagaagtgaggacaaaaaaaacctcatctccggatgaagatgaggtcgggtactacgccgttatggctatagcatcaggtgaccggagcggggttgaacaccgccagctggttatgcaggccccactgatcggagaaggttttcttacgcccgctggcgacatccagaataaagtggaacagccgccagcctacttcctcgatggtttcttccccggtggcgatagtgcccgcgttgatgtccattaagtcataccagcgagtcgccagctcggtgcgggtcgccattttgatcaccggtacggccatcagaccgtaaggcgtaccgcgcccggtggtgaacacctgcacggtaatgccggaggcgacctgctgggtgccgcagacaaaatcgctggcgggggtggccgcgtaaatcaggccgcgtttcgtcgggcgctggccaggcgacagcacttctgaaatggcgctctggccggatttggcgatagagccgagggccttttccaccacgttcgccagcccgccttttttgttgccgggggacgggttggcgctgcggtcagttttgcccatatccagatagttatcataccaggccatctcttcgagcaggcgtttacccacttcttcattgatggcgcgcggggtgagcagatggatggcgtcgcgcacttcggtgacttcagaaaacatcacggtcgcgccgcagcgcaccagcagatccgaggcgtagcccaccgccggattcgccgtgacgccggaaaaggcatcgctgccgccgcactgggtgccgaccaccagatcggaagccgggcaggtttcgcgctggcgcaggttaagttttgcgagatggcgttccgccacggcgagaatgtcatccaccatggatttaaagccgacatgctgctcatcctgcaaacgcacgatgctggccccgtcagccggaatagccagcacatcgctggtgccttccagcaggcgttccggttgcagtttttcacagccgaggccgaccaccatgacttcgccgccaaagttcgggttgagggaaatattgtggatggtgcggataggcaccaccgctgccggggcgttgatcgccacgccgcagccgtaaaggtgattcaggccgaccacgccatcgacgttcgggtatttcggcagtaaatcgcgttcaatgattttcaccacgtaatccaccacgcccgccacgcagtgcacgctggtggtgatgccgagcaggtttttggtgccgacgctgccgtccgcgttgcgatagccttcgaaggtgtaaccttccagcggcggcaaaggttcaggtacgcgggtcgccagtggcagggtattgagcggcggggcttccggcagttcaacggtcgattcgtcaatccagctgccacgcgcgacatcacgcaccgcataaccgataacctcgccgtaacggatgatttcgccatgagccggaatatcggtcagcgccactttatgcccctgcggaatgtgctctgtgagttcaagcccgtcagggaagcgggtgccggctttcaggccattgtcattgacaataattgcgacgttatcagtgtcatgaaccttaatataaaaggctgccggcgaatattgtcggatttcgatatcggccattgtccagtattctccagtcaatttatggggcaaaaatgagtaatttaagcgtcgctttctggttattaatatttaaagggagcggtaacggaataaagcatggcaggtgtcacagttgaataatgtgatcgccatcactcatcgttaccctcgcaagccccaccgcgcagacaagataaaatatgtgcatcagcgcccagcaccttgtgcagatgctcaataactttgttctttatgatgagtaaattgagcattgcaacaatgcgcaaccggcgtacgttatttatacttattctcgttttctttgtattctggtgttttaaataatgccatcaggaattgcatttaatcagaaaataattaagagcgggattttgctggcgacagaaacgcataatttaagtatcggttaattcaaggtatatacaatgaataacactgttttcccgaacacatttaaagctgcgctggcggcgaatcaggtgcagattggctgctggtcggcgctggcaaacccgtttaccacagaagtgctgggccttgccggttttgactggatcctgctggacggtgaacacgcccctaacgacgtactttctttcgtgccgcagctgatggcgctcaaaagcagcagcagcgcctctgtggttcgcgtaccgaccaacgatccggtggtgatcaagcgcctgctggacatcggattttataacttcctgatcccgttcgtggaaaccgaagccgaagccgcgctggcggtagccgccacccgttatccgccggaaggcattcgcggcgtatcggtatcccatcgcgccaatatgttcggcaccgtaccggattacttcgcgcagtcgaacaaaaacatctcaatcatggtgcagatcgaaagccaggccggcgtggataaccttgacggcattctcaccactgacggcgtggacgcggtattcgttggaccaagcgacctggcggcaagtctgggctatctcggcaacgccgcgcacccggacgtgcagcgtgtcattcaacacatttttgcccgcgccaaagcgcacggcaaaccggcaggcattctggccccggtagaggttgatgcccgtcgttatctggaatggggcgcgaccgtagttgccgtcggcagcgatttaggcgtattccgcgccgccacgcaaaaattagccgacgcctttaaaaaataaccacgacgacaagagagacataattatgacgatgaaagtgggtttcattggcctgggtatcatgggtaaaccgatgagcaagaacctcatgaaagccggttactcagtggtggtggtagatcgcaatcatgatgccgtgtcggaaatggttgccgccggtgccgaaaccgccgcaacggcaaaagaagtggccgaacagtgtgaggtgatcatcaccatgctgccgaactccccgcacgtaaaagaagtggcgctgggggacggcggcattatcgaaggcgcgaaaccgggcaccgtgctgatcgacatgagttctatcgcaccgctggcgagccgcgaaatcagcgaagccctgaaagccaaaggtattgatatgctcgatgcgccggtcagcggcggcgagccgaaagctatcgacggtacgctgtcggtgatggtgggcggcgataaagctatttttgataagtattacgacctgatgaaaaccatggcgggatccgtggtgcataccggcgatattggcgcaggcaacgttaccaaactggccaaccaggtgatagtggcgctgaacatcgcggccatgtcggaagccctgacgctggcgaccaaagcgggcgttaacccggatctggtcttccaggcgatccgcggcggtctggcgggcagcaccgtactggaggcgaaagcgccgatggtgatggatcgcaactttaagccgggcttccgtattgatctgcacatcaaagacctgtctaacgcgctggatacctctcacggcgtgggcgcgcagttgccgctcaccgcggcggtcatggaaatgatgcaggccctgcgtgccgatggtcatggcaacgacgatcacagtgcgcttgcctgctattacgaaaaactggcgaaagtggaagtctcccgctgatccccgcgcccggtggcgtcacgctgccgggcctgataagtaagccgaaaagctaatccctcctgcgacatgcggtaacaggctacagatatgaaaatcgtcatcgctcctgattcatataaagaaagcctgtccgcttcagaagtggcgcaggcaatagaaaaaggctttcgggaaatttttcccgcggccgagtatgtctgtgtcccggtcgctgacggcggcgaaggcacggtagaagccatgattgccgccaccgggggcacggcgttcgtcgccccggtcaccggcccgctgggggaggtggttgacgcacgctggggcatctccggcgacgggcagaccgcctttatcgaaatggcggcggccagcggcctggcgctggtgccgtccgcgttacgcaatccgctgatcaccacctcgcgcggtaccggcgagcttattctgcacgcgctggaacagggcgcgcaccatatcattatcggtatcggcggcagcgccaccaacgacggcggcgcaggcatggtacaggcgctgggcgcgaagctgtgcgatgccaatggtacggagatcggcaacggcggcggcagcctgatgagcctgaattcgatcgatattacggggctggatccacgccttgcccggtgcaccctccgtgtggcctgtgacgtcactaacccgctgctcggcgaccagggcgcgtcgcgtatcttcggcccgcaaaaaggagcgagcgaggcgtgcattattgagctggacaaaaacctcgctcactatgcggacgtcattaaaaaatccctgcatgtggatgtgaaaaacgtaccgggcgcaggcgcggcgggcggtatgggggcggcgctgatggcgtttctcaatgccgagttgcgcagcggcattgaaattgtgaccgacgcgctgaacctcgaagaacatattcacgattgtacgctggtggtgaccggcgaaggccgcatcgacagccagaccattcatggcaaagtaccggcgggcattgcctcggtggccaataaataccataagccggtgatcggtatcgccgggagtctgtccaccgatgtgggcgtggtgcacgatcacggcattgatgccgtgttcagcgtattaaccacggtctgcacgctggaagaggcgtttcgcggcgcgtctgacaatatttatcgcgcttcgcgcaatattgccgcgaccttgcaggtcgggatgttgagcgaagggtgacatcgcggcgcaaaccctctatacttcgcgccgaagctgaccagacagtcgccgcttcgtcgtcgtcccccctcggggggagacgggcggaggggaggaaagtccgggctccatagggcagggtgccaggtaacgcctgggggggaaacccacgaccagtgcaacagagagcaaaccgccgatggcccgcgcaagcgggatcaggtaagggtgaaagggtgcggtaagagcgcaccgcgcggctggtaacagtccgtggcacggtaaactccacccggagcaaggccaaataggggttcacaaggtacggcccgtactgaacccgggtaggctgcttgagccagtgagcgattgctggcctagatgaatgactgtccacgacagaacccggcttaccggtcagcttcaacttcttacagaaccccgctccggcggggtttttgctttctgctgtatgcgttttgattttgccgggtggcgcttcgcttacccggcctacaaactgacgcttacccggcatggcggtgttgtgcccctgtaggcccggcaagcctgcgccgccgggcagggtaaaaacaacctacatcggtaaatcaatcagcaatgcacgcagcggcgtatcggcgacgagggtaatattcggctcatcacggataaaggccccgtcgccgcaggtcagggcctgttgcccggtctggtgcgtcacggcgtgcacgctgccatggatcgactgcaaataggcgcgcgggccgtggagatggaaactcagctcttcgcctttttccagttcgatatgatgaacccacgcctgctgacgcagttgcaggctgccctggctgccgtcaggcgaggccagcagttgctgcgcatgatctgccagcgaaattttctgcaccagcgaattttcccgctcggggctggcgtccagccacagctgcatacgcgtcagggatttatctttgctcaggttgtgttcgctgtagctgatgcccggctgcgtggcgatcagcagcgcatcgcctgccttcgcctggacatgatgaccttcactgtcgcggtactcggcttcgccttccagaatgagatttaaaatatccacttttggataggtacgcggctggaatgatgcccccggcgccagcacttcctggttcagcacccgcaacgaggcatagcccagcaggttcgggtcaaaataatggccaaaggagaaggtgtagcgggcctgcaaccatccgaagtcggcctttccgcactgtttggctgttcttgtcgtgatcataatgtctgccctctctttacacttaaacaatggtaaaggtatggacgctgcattgttagccagatattctgcccggtatgttcaaatttcctgaatgaaaacgacatggctaaagaaagagcgttaaccctcgaagcattacgggtaatggatgcgatcgatcgacgcggcagtttcgcggcggcggcagatgaactgggccgtgttccttcggcgctcagctacaccatgcaaaagctggaagaagaactggatgtggtgctgttcgaccgctccggccaccgtacaaaattcaccaacgtgggccgtatgctgctggagcgcgggcgtgtgttgctggaagcggcagataagctgaccaccgatgcggaagcgctggcgcgcggctgggaaacccatctgacgctggtgaccgaagcgctggtgccgacaccgtcgttcttcccgctggtggaaaagctggcgacgaaagccaatacccagctgtcggtgatcaccgaagtgcttgccggggcatgggagcgtctggagcagggccgggcggacatcgtcatcgggccggatatgcattttcgttcctcgtcggaaattaactcgcgcaagctgtataagatcatgaatgtgtacgtggcggcaccggatcatcccattcacgatgaacctgaaccgctctcggaagtgacgcgcgtgaaatatcgcggcgtggcggtggcggatacggcgcgggaacgcccggtgctcaccgtacagctgctggataaacagccgcgtctgacggtaagttctattgaagataagcgccaggcgctgctggcggggctgggcgtggcgaccatgccctatccgctggtggagaaagacatcgctgaggggcgtctgcgggtggtcagcccggaatattccgccgaagtggacattatcatggcctggcggcgcgacagtatgggagaagcgaaagcctggtgcctgcgcgagatcccgaagctgtttatcaataaataagcgactcctccgcccggaggagccagcaggatcaggggacctgttttggatccggtccaaaacggttttcgcctggcgtaccgctctggcagttaaaggcgatgatcaccagccagccgatcaccgggatcagcagcaataacaaccaccacgccgagcggtcagtatcatgcagacgacggaactgcaccgcccaccacggcagaaaaatcagcacaccataaattgtggtcagcacgccttcgccgctgccccgctgaaaccccaggatattatccacaatccccagcaccgcggtcagcacgatgttgaccagaataaacatccagtactctttgcggcgcgcacgcccgcgaaacccaatgtagttcctgagaacttttaaataccagtccatgttagcgcctcaatctgtggttaattcactgttttatcagcaatcatattaataatagctatcaatatttcgtcggtaaatatcatgcgtctgaattaatcgaagcgatcatttttacgctggcattccggggaggatcacaaaacgcgttgcgtctgttgtgatcctcctcacctgaaatgatcccgttctgtgaggctgctcgctttttaatcgccggagtcggttttcacgaattcattcactgccgcgctgatttacagccagcgcgcgcgccgccatgctgacgtcatccggcgcttcctgttcaagactgcgggccaggtcattaagccgcgccggactgagcaggttccggaagatgtaaggatgcttctcaccttcgccggtaaaccagacgtccagctcacgactgatgctgcgcaacgcctgtagcgcgtcggtgaactgccgggccataccggactgcgcgccatatttgcgtatccagatccgcagcacgatggcccgcgtcacggcgctgtaagcgcgggtataccacagggcgcgggtggtggtgtcggtgaggcggcgagtgaatgccgggctgagatggttatcgctctgcaactgctgggcgagggtctgcatatgaccggcgaggaacagcgtctgctgccgttccagttcaataagctgaaactgttgctgacccagttcgggatcgtcggcgggcatcagcggctgaaacgcctgcgcccagtttgcgctgcgggtatccagatgcagcaggtgcaatgcctgctggaaggtggcgggcggctggctgtgagattgcagcacgcggccaagcagcgtcggggttttgcagctccattcgtagctggcgctcagcaggttgctgaacagcgtctcaagatgcagcggcaggggcgctaccgcatgggtttgcagccaggcgcgcagaagggctgcgggcgtgctgtccggctcgcgcacctgccgggcaaggccgtagagattgatttcattaagggagtcggtcagctccagatcggggatccactcccagttaaggcgcagggtaacggcttcgggcatcgcgccctcctgaccgctgaaccactgcaaacgctggtggaactcctccagtaaatagcagggcagcagcgtccagccgtattcgatgccccacatatcaaactccagccatttggtgaagcccgtcagggtggtcaggttggggttgttggcaaagccgggacggtaatccagctcggtggctttgaccgaggcgcgcacatcgccgggcagcgcctccagcgcggtttttaacatatgccgcggccagcttttgtcccggtaatcgcgcagcaccagctggcgaccctgacggcgcactgactggtacagcaggtttaatacgcctttccacgcttcgttgctcatgtcgggggtggaaagggagagccgtaatccgcgtaccgacggtagcagccggagcagttccggaatggcatggccgaacagccagtcggtaaagctggcgtcatcgccgcgcgattccgtgagaaagaactccgggaatttcgctttctgttcgctgcagtcgggggtggcttccccctgtaaccagagttgcagatggtgctcatcgcagtagcggctgaccttttgcagatacaaaagcgcatggtcgcggcgatggatcaaatggcgaatgtcgccggggcggcagccgggcgagggcgcggcaagatcggcgatcagcgactgctgatgaatgataaggccattgaaatggtgcgccttcaggatggcggcaatgtgctggaaatagtgccagtcccatattttcggcgtgttgacttccagcaataacaagggtgcagcggacattatgacctgtttcctggggaagcggttcactcaccatacgggcaagcgcccggacgatcgacagttatttatcacgaacggagaaaaatgatggcgaaaggggatagggttcagcttcattattatgaatataccgatgaggataccggcgcacgggttattcgcctgacgccgccggatattatttgtcatcgtaactacttctatcaaaagtgtttcctggatgagggacgccagttaattttcgccggcgagttcagcggcacgcgcaattattatttactcgatatcgccagcggcgaagcaaaacagcttaccgaagggccgggggataatacctttggcggttttctttcaccggatgagcaatatctttattacgtgaagggcgagcgcaatctgatgcgcgtgacgctggcgacgcaggaagaaagcgtggtgtatcgcgtaccggacgactgggtgggttacggcacctgggtggcgaattccgactgcaacaaactggtgggcgtggagattcatcgcgacagctggcgacccatcagcgactggaccgtcttccaggagttttatgccgagcagccgcgctgccgggtgatccgcatctcgctggaaaatggcgagcgggaaaccctgctggaagaaaatcagtggctcgggcaccccatttaccgtcctttcgacgacaacacggtggctttctgccacgaagggccgctggatcaggtggatgcccgcatgtggctgatgaacgaagacggcagccacatccgcaaagccaaagagcctgcgccgggggagagctatacccatgaattctgggtgccggacggctcggcgctgatgtacgtcacctacgtcaaggacagcccggtgcgctggctgtgccgggtaaatggcgacaacggtgaagatgagaagctgatcgccatgccgccgtgctcgcacgtgatgagcaacgacagcggcacgctggtggtgggcgacggctccggtaaacccattgatattgccgataacgcgggctatggcgatgccaccgatccctatctttacctgttcgatattgcccgcaagcagacgcacaaagtggcgcgccacagctcgtcatggcgcgtgctggacggcgatcggcaggtgacgcatccgcatccgtcgttcacgccggatgaaaaacaggtgttgttcagctccgataaagacggcctgccggcgctgtatctggcggatattccagaccacgtattacgcagcattcattcctgagagagcgcgctatgttaaagaaattcttgcccgtcacggcatcgttgttgctggtctgcgcctgtgcggcggtggcccagcctgcggaaattcgtatctcctggtggggcggcaacagccgtcatcaggcgacgctgaaagccattgagctgtttgaaaagcaaaacccggatattcaggtgaaagcggaatatgcaggctgggaggggtatctctcgcgtctgacggtgcagatggcggggggaaatgaaccggatgtcattcagaccaactggaactggttgccgctgttttccaaagacggcgacggtttttatgacctgctgaaactgaaagagagcatcgatctcagccagtatgatccgcagtcgctgcaaagcgtcatggtgaataacaagctgaacggtattccggtggcgatgaccgcgcgcagtttttattacaaccagaaactgtggcaggaaatgggcgtcgcctatccgcaaagctgggatgaattaaaagccgccgggaaagcctttaaagcgaaggacgaaaataaatatccgctggtgctcgactatatggagtcgatcaccctggtgcagtcatggatggtacaaaaacataatatcgccgccatcgacgaaaaagccgggaaatttaattacaccccgcagcagtgggtggagtttttccaggtctataaagatctggtggacagccacgtcttcccgtcgacccgcgtgctgtcgtcatacggtaaatccaacacctgggaaatgaagccctggatccaggggcaatggggcgggatctatatgtggaacaccaatgcggtgatgtacgagaacaacctcgccgcgccttataacaagctggagctggggccgttctttatgctgccaggcgctaaggacgcggggctgttcctgaaaccgaccatgatgttcagcgtggcgaaaaccagtaaacatccgcagcaggcggcgaagctgatcgacttcctgatgaacgatccggcaggcgtggcggcgatggggctggagcgcggtacgccgctgagcaaaaaggccgtggcgcaactgtcatcgagcggcgtgttaaaggatgacaatattaccgttacggggatcaagtcgtcgctggcgctgccgcataagatcccgacttcgccttactttgataacccgcagctggtggcgctctggcatgacaccattcagaacattgaccagggcaacctgacggttgaacaggcggcgtcgcagtttgccaaaaaagccgggcgcattttacagcgggccgtcaaaaaatgatcgccttcagcgccaccctggcctgtcagtacgacacggctttttcgccctttccggccgcgcaatttggtcacgggctggcctggctgtcggccagcggctttgatgccgccgagctgtgcatcaatgattacgagggtgtggaggtggcggcgatctgcgaggcgttaggtcgtgcgggtcttggttgtaccaccatcgccaccggccaggcgcgtaaacgtgacgggctgacgctgctgtcggcggataaaagcgtagtgcgccgcacgcaggcgcgactatttgaacatattgacgccgccgcgcagcttggcagccacgtcaccattggatcgttgcgcgccacggatctgccgctggataaagggcagtatatgagcgagctggcggcggcgctgtttccctgcgtcgagtacgcgcggcgcaacggcgtggtgctgatcctggaggcgctcaaccgctatgaagtctgtcagttgcacagcgcgcaggagatgatggattacctggcgttcagcgatgcgccggaaaacgtcggcgtgctctgggatctgttccacgccagtattgaagatgcggattatgcgcaggccatcgccacgctcggcccgcggctgcgccatgtgcatctggcggattcgaaccggggatttccggggtacggacatttaccgctggaggaggtctacaccgcgctcaggctggcgggctatcagggggcggtatcgctggagtgcttgtgtaggccgtcggcgcaaaccgtgatcgacggggcgggggaactggtggcgcggctgcggcgtctgtaaacgccgccgccgcgcgggtcaggtcattcgctgtcgcggctgccgaaacggctatcgcgaccgtgcggctcatcaagatcctgccacgggccgatggaaataataccggtcgggttaatggtcttgtggctgcaatagtagtgggtgcggatgtgcgcaaaatccaccgtttctgcaatacccggcatctgccagatatcacgcaggaagccatgcagattcaggtaatcgctgatgcggtgcttatcgcatttgaaatgcgtgacgtagaccggatcgaagcggatcaatgtggtccacagacggatatcggcttcagtcagacgatcgccggtgagatagcggtgctggccgaggatctgctccaggcgcgacagcgaatcaaacagcgcggtgaccgcctcgtcgtaagcggcctggctggtggcgaagcccgctttgtagacgccgttgttcacagtgtcatagatccagccgttcagctcatcaatctgcgactgcaactccgccgggtagtaatcccccgcgcgggcgccctgcgcatcgaacgcggtattgaacatgcggatgatttccgccgattcattactgacgatggtctggttctttttatcccacagcaccggcacggtgacgcgaccgctgtagtgcggatcggcatgcagatagagctggtagaggaagtcgtgctgatagagggtgtcgccggtcgccgccgggaaattgtcgtcaaaggtccagccgttttccagcatcagcggattaaccaccgagacatcaataaacggctccaggccttttaatttacgcatgatcagcgtgcgatgcgcccacgggcaggcgagggaaacgtagagatgatagcggcctttttcagcggcaaatccaccttcaccgctcgggcctggcgcgccatcggcggtcagccagttacgaaaagcggaaaccgaacgcttaaaactgccgcccgtcgatttggtgtcgtaccaggtgtcgtgccagacgccgtcaatcagttgtcccatcacgttctccttcaggttgggcagatgcgcaaaaaatcacaggccaggttagcgaagcgccacctggcaaaggttgacaatgcccggcggcgctacgcttgcgctggcctgcatactacgtcagcagtttagtatagaagccttaccattttttattcagtacacggtcgatgctaaatgcacccggcccggtgatgcccagcagcaggaagccgccagcgatggacagatttttcatgaacatcagcgcattcaccccttccgcaaagttattgtggaaaatgaaagcggtcagcagggtaaagcctgcggtgaacagcgcggtggtacgggtcaggaaaccaaacaggatcgccagaccgccgccgaactcaagcagaatggtcagcggcaggaaaaagcccggcacgcccatcgcttccatgtactgttgtgtacctgcatacccgttgatttttccccagcccgcatagataaacaggattggcatcagaatacgcgctaccaggaaaccaacatcttgtaattttttcattttactctccagaaatctcatgcggtatgcaagtgtgattgttcaggcagttacggcgtctggcgcacgtttgccgtcgatggagaggataataggcgtagcgttaagagattgttagcaaggaaaactgtcaatctttatcaaatattctgagtaataacaggcgggagaaatatacccgacggcgatccgccgggcaggggacaggttaacgcaggtgttgctgacgtaacgtcgtttgcaccaggcgccaggcgctccacgcagcaaaaccgcgcttcccccagcgtaccagcatattaggattgcggatggtgcgaatagccagcaggctactgcccaccaacgcccatgagcgcaggcttaacagcgtattccatccgcgatcgtaagatacggttctctcttcccagtcgcgacggctggcggcgagatccaggcgttgctgctggatctggctcagcagcacggccttacgcctttggcgatcaatctgactgctcatctcaatcatcctccagcaacgaacgatcgttggacagctcctgacgggtatgacgcagcagagtagaccggcgcgctttacgcagggtccatatagcaccaatcaatgcgccaatcagcagtaccgccgtcgtgccaatcatgacgttcagacggtattgcgggtcaatggcccagatgatcagcaccatcagactcatcagtccgaaagcggcgaacagcatggtcagacctaccatcaggagcagctggaagagattcgctttctcttcttccagctcaaccactgccagccgcagacgcgtttccaccatctcaacgatgatggtcacaatgcgctgcccgatgcccagaacgcttttaccgggcccgtttgtgtgacgtgaactatccataatcaacgacgcgaaatcaggacgcccagcactacgccaatcgcagcaccgatgccaacgccagtccatggattctcacgtacataatcttcagccttaccggccgcttcgcgtgtctgtttagcgataatgtcactggtctcgcccagacggtaacggctttcatgcagcgcacgttcagccttgctacgcagtttactcagctcttctttcgattttgacccggagctattcagcacttcttccagggtgtccgtcagggatttcaactcagcgcgcagatgttccgtattggtatcttttgacatagttctctccagtgagtgagtgttaacttcctttaataatcccgagcctcaagcgctttcagttcttcctgagcctctttcagcttatgttctcttttgaacaccttatccgcatcgcctttttgcttcgcttcctgaagatcctgctcgcgttcggcaatctcttctttctgatcggcgatcttctcctgatgatcggcgcgcaatttgctgtccgtgcaattggctctgacttcgctaagtgctttattcaggccgtcgatacggctctgattattgtgcttctcggcgtaacggatttctttttgaatatcctgctccttttcctgacaaagggaagcagcctgtgaagcggcactcagtgaaaaaagggctaacgccagtgcggtgcggtatttcattcttgaaaccttccattgttgctacgggcctcaacatgaggcgccgaaatccagttgattaaaagagtaagatgggtgcccgtgtactaagcatagtaacgaacggggagaaaaccaaaatgcgggcgaagtttcggaataattgaagttttcaacccagccgatgtggcgtatcgcgcagtcgggaaagccataccgcggctttatcatcgtcatcctgttgcgcgatgatatagccatggggcagggtgcgatcgagcaccactttggcggcagcgctctgcgcgctggaatcaaacttaattaacagcgtgtcattctgcggggtaatgctgttaaagcgaatgccgttagcatccagatgatgccagatagaaaagccgtcaggcacgctgacgctctggctggccgggcgaatagccagcgttgactcacgctgttgtagcgtcgcccaggcaaagaaaaagatcgtgaacagcatgactgctgccaccattaaagcaacgcgcttcatcgacgtgcgttgaataagcatccggttattcctgctttccatattttttcttccataacaccaccagcgtaccgatgagtccaaacaccagcagtacgaccggcagcaacatcaggcaggacatcagcgcatcctcatacttgaggaaaaccggcgtcttaccaagaagatagcccagggtcgtcaggatcaccacccagagcagaccgctcatccagttgaaaaactggaagcgcgcattgttcagaccagagatcccggcaatagttggtaacagtgtgcgaacaaatgcaataaatcgccctaacagcagcgcagacaggccgtgtttgtggaacatatggtgcgcgcgctggtgataatgcgcgggcagatgcgacagccagttctgcacaatgcgggtgttacccagccagcggccctggatgtagctcagccagcagccgaggctggcggcggtagtcagcagcgctatggtgagcggatagctcatcgcgcctttggcgatcagtacgcccaccagcactaacaggctgtcgccgggcagaaaggcggcgggcagcaggccattttccaggaacaaaatcataaacaggacgaaataaagcatgccgatcatggaaggattcgccagcgtctcgaaatcctgactccacaatgcattaagtagctgagtaaatagttccattcgttattcctggtacatcggttaacgtcacgccagatcggatcctgtgcacctatacgtgcgggcaaattgcatctaattgtaacaaatgccggagttctgcgtctcaaaatttatgaaatgtaagaattgattttgcttgtggcgtaggggggagaccagagtatttacaaaggctgacactctataccttttgttactgcggggagcgcagcaagcgcaggagcgcctgctgtggaggataaaaatttattttaccgcgttcgcggcagcatcaaggtgaaccacaggattatctgcaaaaagatagcggtcagcgttgaattcgaaatcatcgctggtttcgttaaacagcatctgtttagtgttttccagatgctgccacatcgccagcttggcggcatgcgggtctttacggatcagggctttaaggatctggtcatgatcgtcgcaccagttatccacggtgcgtaaatcgatatgatcgtgcagctttttccagtacgggttatgaatacgctgcgtccacatcttttcgacaattgccgccagcgccgtattctgcgtggcaagggctacctgcacgtggaactgcaaatcccattcggaatcgcggaagcatttctcctggcgcgcccgatcctggatttccatcagcttcatgatgtcctgtttcgtcacctgggtggcggcgaattcggcaatattgctttcaatcagctggcgggcctgtagcagttcaaacgggccgtagttggcgaactcaagcgtttcgtccggcacctgctggtatttaggctggttcgacatcacgtggatcccggagcctttacgcacttcaacgtagccttccacttccagcatgatgatggcctcacgcaccacggtacggctgacgtttttttcatccgcaatgaagcgctcggcaggcagtttatcaccaacgagatacacgccgttttcaatacggcttttcagctcagcagcgagctgctgatacaaacgacgcgtgtcagtgatttccatatacactccaggcaggataagacagattagatttgttataccacttttacgccattctcaccaccgcagaaaagtaaaaagccgccccggacaacggggcggctcgtatgcaaatggtttaacagcgcgttttaactttgtgtcgcaggtccgccataggcggctttttccgcttccagctccgcggccgatttacttttcagcaccgtccagatcaccacagcgcccatgatgtcgaacactgccagtaccgcgaacagtgggctgaagccgatggtatccgccagcgcacctactaccagcgcaaacatggtgcttgccgtccaggccgccatgccggtcagaccgtttgcggttgccacttcgttacgaccgaacacgtcagaagagagggtgatcagcgcgccggacagggactggtgagcaaaaccaccgatgcacagcaggccgattgccacatacgggctggtgaacaggccgatcatgccagggccaatcatcagtaccgcacccatggtcaccaccattttacgggacacgatcaggttcacgccaaaccagcgctggaacagcggcggcaggtaacccccgacgatacaacccaggtcagcaaacagcatcggcatccaggcaaacatcgcgatttctttcaggttaaagccgtagactttgaacatgaacagcgggatccaggcgttaaaggtaccccaggccggttctgcgaggaaacgcggcagggcgatgccccagaactgacgggtgcccagaatctgccatacggacatttttttgccgttgttggtctggtgctgcgcttcctgaccgccaatgatgtagctacgttcttcttcggtcagttttttctgatcgcgcggatgtttgtagaaaatcagccatgccatagcccaggcgaagctcagtacgccggagataatgaacgccagctgccagctgtgcatcacgatggcccagaccaccagcggcggggcaatcatcgcgccaatagaggaaccgacgttgaagtagccgacggcgatagaacgctctttggccgggaaccactcggaggcggctttcagacccgccgggatcatcgcggcttcagcagcacctaccgcaccacgcgccagcgccagtccaccccagcttcccgccagcgctgttgcgccgcagaagatggcccaggtcacggcgaagaccgcgtagccaactttggtgccgagaatatccagcacataacccgccaccggctgcatgatggtgtaagccgcggagtaggccgcaataatgtaggaatattgttgcgtggaaatatgcagttcttccatcagcgttggtgccgccgcagcgatggtattacgcgtcaagtaacccagcacggtaccgagcgtcaccagcgctatcatgtaccaacgtaaccctttaattttacgcatgtaaacctcatcgttatgttatttccgcctctggcggttcacctcccgaccaggtcgggggatgttatgtaacggggggagcgaaatcgggactgattcccggtacggtccaaaccttgccattgtcattcgtgcgaaattcggtatccgtaccgttaatccgggtgagtaactcacctgtaatacattccgtcggtctatgttttgcgacggcagaaagataacttgtcatacaactttaaaaggtgagtgacatcacaaaagtgcgtttctttgtgtggtctttattttcggtcagcgaagccagagctggcgcggcctgcgggggtgtttaccccaatcggggtagtttatttgtcaggatttattgatctaactcacgaaaatatcttcggtctgtagaaattggtgtgataactttgtcagcattaaggcatacatctacgctctttttagaggaagacgataatgactccgtttatgaccgaagatttcctgttagataccgaatttgcccgccgtctgtatcacgattacgcaaaagatgagccgattttcgattaccactgccatttaccgccgcagcagatcgcagaaaactaccgctttaaaaacctgtatgacatctggctgaaaggcgaccactacaaatggcgcgccatgcgtaccaacggcgtgccggagcgcctgtgtaccggcgatgcctctgaccgcgaaaagtttgatgcctgggcggccacggttccgcataccatcggcaacccgctgtaccattggactcaccttgaactgcgtcgcccgttcggtatcagcggcaaactgctgtcgccgtccaccgctgacgagatctggcatcagggtaacgaactgctggcgcaggagtccttctctgcccgcggtatcatgcagcagatgaatgtgaaaatggtcggcaccaccgacgatccgattgactcgctggagcatcacgccaccgtcgcgaaagacacttccttcagcattaaagtgctgccgagctggcgtccggataaagccttcaatattgaacaggcgacctttaacgattacatggcgaaactgggtgaagtctccgacaccgagatccgccgtttcagcgatctgcaaactgccctgaccaaacgtctggatcactttgcggcgcacggttgtaaagtctccgaccacgccctggacgtggtgctgtttgcggaagcgaacgaggccgagctggacagcatccttgcgcgtcgtctggcaggcgaaaccctgagcgagcatgaagtggcgcagttcaaaaccgccgtgctggtgttcctcggcgcggaatatgcacgccgtgaatgggtgcagcagtaccatattggcgcgctgcgtaataacaacctgcgccagttcaaactgctggggccggatgtgggctttgactccatcaacgaccgtccgatggcggaagagctgtcgaagctgctcagcaaacagaacgaagaaaacctgttgccgaaaaccatcctttactgtctgaacccgcgcgataacgaagtgctgggcaccatgatcggtaacttccagggggaaggcatgccgggcaaaatgcagttcggctccggctggtggtttaacgatcagaaagacggcatggaacgtcagatgacacagctggcgcagttgggcctgttaagccgctttgtcggtatgctgaccgacagccgcagcttcctgtcctatacccgtcatgaatatttccgtcgcattctgtgccagatgattggccgctgggtcgaagcgggcgaagcccctgccgacattcagttgctgggcgagatggtgagaaatatctgctttaacaatgcgcgtgactacttcgcgattgaactgaactaaggccgtttgaggttgatatgcaatacatcaagatccattcgctggacaacgtcgcagtcgcactggctgacctggcggaaggcgcagaagttaccgtagataaccagacggtgcggctgcgtcaggcagtaggacgcgggcataagttcgccctgcgcaccatccatcagggcgaaaacgtggtgaaatacggtttgcctattggtcacgccacggcagacattgctgagggtgaatatattcactctcataatgcccgcaccaacctgagcgatctggacgagtatagctatcaacctgaacctcaggctgaagccgcgcagggtgcggatcgcgacgttgagatctaccgccgggccaacggcgaagtcggcatccgcaatgaactgtggatcctgccgaccgtcggctgcgtgaacggtatcgcccgtcagatccagacgcgctttctgaaagaaaccaacgatgccgaaggcaccgacggcgtgttcctgttcagtcacacctacggctgctcgcagctgggggatgaccacatcaacacccgcaccatgctgcaaaacatggtgcgccacccgaatgcgggcgcggtgctggtgattggcctcggctgtgaaaacaaccaggtcgacgccttccgcgaaaccctgggcgactttgatccggagcgcgtccactttatggtctgtcagcatcaggacgacgaagtggaagcgggccttgaacatctgcatcagttatatgaagcgatgcgtcacgaccaacgcgagccgggcaaactgagcgagctgaagtttgggctggagtgcggcggatccgatggcctgtccggcatcaccgctaaccccatgctcggtcgtttctccgactacgtcatcggtaacggcggcaccaccgtgctgaccgaagtgccggagatgtttggtgcggaacagatcctgatgagccattgtgtcgatgaaaccacctttgaaaaaaccgtcaccatggtgaacgatttcaaacagtattttatcgcccacaaccagccgatttacgagaacccatcgccgggcaacaaagccggtggcatcactacgctggaagagaaatccctcggctgtacccagaaagcgggggccagccaggtggtggacgtgctgcgttacggcgagcgtctgcaaaagcacggtctgaacctgctttccgcgccgggtaacgatgccgtcgccaccagcgcgctggccggtgccggttgccatatggtgctgttctccaccggtcgcggtacgccgtacggcggttttgtaccgacggtgaaaatcgccactaacagcgagctggcggcgaagaaaaagcactggatcgattttgacgcgggtcagctgatccacggcaaaatgatgccggagctgctgaacgaattcgtggatgtgattgcggatatcgccagcggcaaaaagacctgcaacgaacgtaatgatttccgcgagctggcgatctttaaaagcggcgtaacgctgtaaacctgttgtcgggtttgtcgggtggcgctgcgcttacccggcatacaggtactgtaaatgccttgccgggcggcgactgcgtcttgcccggcctacagaacctgcaaatcaacccaggcccggcaagctggcgccgccgggcaataattcttaactgcgcagcgcgtttttcgccagacgttcatcttccgcctggcatgctgccgcggtgaacagcacgtcggtggaagagttaagcgcggtttcgcaggaatcctgcaacacgccgatgataaagcccaccgccaccacctgcatggcaatatcgttcggaatgccgaacatattacacgccagcgggatcaacagcagcgaaccacccgccacgcccgatgccccacaggcacacagcgaggccaccacgctcagcagcagcgccgtcggcaaatcaaccggaatacccagcgtatgcaccgccgccatggtcagcacggtaatggtgatcgccgcgcccgccatattgaccgtcgcccccagcggaatggaaaccgagtaggtatcgcggtccagattcagtttttccgccagcgccatgttgaccggaatgttcgccgccgagctgcgggtaaagaatgccgtcacgccgctttcacgcaggcacagcagcaccagcggaaaaggattgcggcgaattttccagaacaccagcagcgggttgatcaccagcgccaccaggaacatacagccaatcagcaccagcagcagctgcgcgtagccgtagagggtggcaaaaccggtttccgccagcgtcgccgacaccagaccgaaaataccgataggcgcaaagcggatcaccagcttcaccataaaggtcaccgcgtccgacacatcgttaatcaggcttttggtggagtcgctgccgtgacgcagcgcaaagcccagaccaatggcccacaccagaatgccgatatagttggcttccagcaacgcatgtaccgggttagacaccatgctcatcagcaggccacgcagcacttccgtaatgccggcgggcggcgtgatgtccgtcgcgccggtcaccagttgcagggtggatgggaacaggaagctgaataccacggcggttaaggcagcggaaaaggtgcccaccagatagagcaccagaataggacggatattggttttctgaccgtggcggtgattggcgatggatgccatcaccagcatcagtaccagcaccggcgccaccgctttcagcgcgccgacgaacagcgtgcccagcagaccggcagcaagcgcggctggttttgatacccaggcgagcagaatgcccagcactaagccgatgaggatttgttttaccagactgccgtgcaccagacggtgcagcacacctgtgaagtgttgcgtactcatgaggaattccttagatggtgttgtagtgccatcccggacatcctcttaagggatgttcatgtcgggatgtaacaaatgtttgcaaagaggagtatacgcattcgcaggcggcgggaaagaacaagaggctggattggtggcaagtgtcgtgttttttaactgtctgataacatatttgtgacatggtcaacaattaaaccttctccgttgccggagaaggttctgtttgtcagccctggagctttttcttgtcgttctggtgattcacccaggcgttaagcagcagggttatcgccagaataccgcccaccacgccaagggagatggcaatcgggatatggtagaagtcgacgatcagcatcttgataccgataaacaccaggatcaccgacaggccgtacttcagcagcgcgaagcgttccgccacgcccgccagcaggaagtacatggcgcgcagaccgaggatcgcgaacaggttagaggtcagcacgataaagggatcggtggtcaccgcgaaaatagctggaatactgtcgaccgcgaagatcacgtcgcttaactcaaccaggatcagcaccagcagcagcggcgtggcgtacagcagaccgtttttacgcacaaagaagtgctcgctttcgatcttgtccgtcatgcgcagatgaccacgcagccagcgcaccagcggtttatcgccaatacccgcttcgtcttctttcgccagcgccattttcaccccggtgaacagcaggaacgcgccgaagacgtacagcagccattcgaactgggagatcaaccagctaccggcgaaaatcatgatggtacgcagcacaatcgcccccagcacgccgtagatcaatacacgacgttgcaatgcaggcggcacggcgaagtagctgaacagcatcagccagacgaagacgttatccacggccagcgctttctcaatcaggtaaccggtgaggaaggcgagcgcctgcggatcggccacggcacggccttcggtgctggcgaggtaccaccagaaggcggcgttaaacagcaaagagagtgatacccataccagtgaccagacggccgcctgcttcatggacatcgtatgagcgccgcgacgcccctgaagcagaaggtcgatggcgagcatgatcacgacgacaactgcgaatccgccccagagcagcggtgtgccgacagtattcataggaaattccttacataaaaaaaacggctgacgtcgaaagacgatagccgtttattttagatgcacgggtcctcgcctttcggcaaggtctcacttacatccttaaggatgcccggcgaccggatgcttgcgcatcgtaatgacgaccaaccggcaatgaagttactcccctttgctggtaacaaaatatgacagagatcgcattccgtcaatgggtcgtaacaactgttttacatagctttacgccaccggatcggcagccgcttcgctgtcagccgggaaaatcacgccggtctggcggcggatctccgtcagcaagttcgcggtaatacggctgatggcgatgcccggatggttcacttcgttgttttccaccagatcggcaaagcgctctgcctcatacagcatggtattgatatgctgcggttgggagagatcctgtggcttgccgccgcgcggcacaaaagatactttctggcattcggagattttttctatcaccagcgagccttcttcgccctggatctcgctcgccagcaccgattcactcactttggaatgttgcagggtgacgctgaaatcgccgtagttaagcaccaccacgccgtgcgcgtccacgccgctgtccagcagactggccgtggcctgtacgctgtgcggttcgccccataacgccaccgccgaggccaggcagtaaaagccgatatccataatcgagccgttggaaaacgccggattaaaggtgttcggattttcgccgtccagatagcgctgatagcgggaagagtactggcagtaattaataaaggctttgcgcacctttcccactttcggcagtgactgttgcagcagcaggaaattcggcagcgaggcggttttaaacgcttcgaacagcaccacgccattttcccgcgcgcaggcaatggcggcttccacttcacgcagattggaggccagcggtttttcgcagatcacatgctttttatggcgcaggaacagttcgctttgcgaaaagtgcagggagttcgggctggcaatatacaccgcatcaatatcatggctctgcgccagcgcctcaagggaggtaaacagatgttcgaccggataatcgctggcgaaatgctgcgcctgttcaaggctgcgggagtaaacggcggtaagggtatatttgccggtctcatgggcggcatcgacgaactggcgggtgatccagttcgtcccaatgactgcgaaacgtatcataaacggcgttgtgctccgtaaaaggggaccattcgccaatgtagcacgtcagtgtgacaaaaccagtgcgctgcgccgcagaagtcaggcgacgatcatgccagcgcctgatgcgtcagccacagacgagtatcaaactccagttgatgatagtgcggctccatatgacagcacagctgataaaaagccttgctgtgatccttctctttcaggtgcgccagttcatgcaccactatcatgcgcaaaaaggcttccggcgcgttgcgaaacaccgtcgccacgcggatttccgcttttgccttcagcttgcccccctgcacgcgggaaatggcggtatgcagaccaagggcgttattcagcacatgaattttattgtcgtaggccactttgttgattggcggcgcattgcgcagaaactgacttttcagatcctgggtatattgatagagagccttgtcggtggtgacgttgtgcgtatcgggataacgcttttgcagcacctcgccgagccggttctgctcgatgagcgtcgtaacctgggccagcagattttccggatagccctggagatagagaagtttgctcatcattgccccacgatagcagtcaaaaaagggtatactcacgcccccattcaggggatcacaccgaattttaccatccaggagggccgatgagccattcagacaacggtttccgttcacttaacttaaaacgttttccggagacggacgacgtcaacccactgcaggcgtgggaagcggcagacgaatacctgctgcaacaactggacgaaactgaaatcagtggcccggtcctgattttcaacgatacttttggtgcgctggcctgcgcgctggtggagcacaagccttacagcattggcgactcctacctgagcgaactggcgacccgtgaaaatctgcgccataacgatctcaacgaaggggatgtcaccttcctcgacagcaccgcgccatacccggccgcgccgggcgtcgtgctgattaagatcccgaaaaccctggccctgctggagcagcaacttcgcaccctgcgcacggtagtgacgccgcaaacgcgcatcatcgccgggaccaaagcgcgtgatattcacaactcgacccttgagctgtttgaaaaagtgctggggccgaccaccactaccctggcctggaaaaaagcgcgtctggttaactgcactttcagcgccccggcgcttaacgatgcgccgcagaccctgagctggaaactggacggcaccgactggactattcacaaccatgccaacgtcttttctcgtaccgggctggacatcggcgcgcgcttctttatgcagcatctgccggataacctggaaggggagattgtcgatctcggctgcggtaacggcgtgattggtctgacgctgctggataagaatccgcaggccagcgtggtattcgtggatgagtcgccgatggcggtggcctccagccgtcttaacgtcgaaaccaacctgccagaggcgctggatcgctgcgagtttatgatcaacaacgcgctgtcaggcgtcgagccgttccgttttgacgccgtgctctgtaacccgccgttccatcaaaaacatgcgctgacggataatatcgcctgggagatgttccaccacgcccgccgctgcctgaaaatcaacggcgagctgcgcatcgtggcgaaccgccacctggattatttccacaagctgaagaagattttcggcaactgcgaaaccattgccaccaatcagaaattcgtggtgctgaaagcggttaaaaccggacgcagacggtaaatttcccgcccggtggcgctgcgcttaccgggcctacgcggctcatgtaggccggtgcaagcgcagcgccgcccggcaaaggcatacttatatctccagcgccagccgggtaccctgcgcaatcgcgcgacgggcgtccagctccagcgccacatcgcagccgccgatgagatgcacgatttttcccgcttcgcgcagtggctccgccagttcccggcgcggctcctgtcctgcgcaaatcaccacatgatccaccgcgaagagttgtggatcgccgttgatcagcacatgcagaccggcatcgtcgattttttcgtagctcaccgccgggatcattttcacaccgcgcgccagcagggtcgcacggtggatccagccggtggttttgccaaggccttcccccggtttgctgactttacgttgcagcatcacgatctgccgcggacttttcggtaactgcgcgccttccggccgcaggcctccgggctgatccagagtggtatcaattccccattcggcgcaaaactccgcgatattctggctggtggactcacccggctggcttaaatacatcgcggtgtcaaaaccgatgccgccgctgccgatgatcgccacccgctcgcccaccggttttttatcgcgcagcacgtccagatagttcagcaccttcggatgcttgatcccctcgatcggcggggtgcgcggctcgatcccgcaggcgaggatcacctcgtcaaagtctcccagcatgtcaggcgtgacccgctggttcagccgcagatcgacgccggtcaccgcgatcatggtgcggtagtagcgcagcgtctcgtaaaactcttctttaccggggatctgtttggcgacgttaaactgtccgcccggttctgcctgggcgtcgaacaaggtcacgctgtggccgcgcgccgccgcgttaaccgcaaaagacaacccggcggggcctgcgccaatcaccgccagctttttgatcttcaccgccggtacgatcggcattttggtttcatgacaggcacgggggttgaccaggcatgaggtcactttcccggcgaagatctgatccagacaggcctgattacagccgatacaggtgttaatttcgtccgcacgtccggcctgcgccttggaaaggatcgccgcatcggcgaggaaaggccgcgccatcgataccatatccgcgtcgccgcgcgccagaatctcctccgccacctgcggatcgttaatgcggttagtggtgattaagggcagtgacactttgcccttcagcttacgggtcgcccaggtaaaggccccgcgcggcaccggcgtggcgatggtcggaatgcgcgcctcgtgccagccgatgccggtattgataatgctggcccccgccgcttcaatggcctgcgccagctgcacggcctcctcaaaagtgccgccgccttccaccagatcgagcatcgacaggcgatagataataatgaagtcgctgccgacccgctcccgcaccgcgcgcaccacttcgacggcaaaacgcatccgtcgcggatagtcaccgccccattcatcgtcgcgctggttggtgcgggcggcgaggaattcgttaatcagatagccttccgatcccatcacttccacgccgtcatagcccgcttcacgcgccagcgcagcgcaacgggcaaagtcgtcgataagcgcgaggatctcctcgtgcgtcagggcgtggggtttaaaacggttgatcggtgcctgaatggcggaaggcgcgaccgggtgcggctgatagctgtagcgcccggtgtgcagaatttgcagggcgattttgccgccctcgcggtgcaccgccccggtgatgatctgatgatggggcacctggctggcatcacagagcaccgcgccgccttccatggtaacgccggagaacgccggagccacgccgccggtgacgatcagcgccacgccgtgccgggcgcgttcggcataaaaagcggccagtcgttcggcaccgtcagggcgctcctcaaggccggtgtgcatggagcccatcagcacgcggtttttcagcgtggtgaaacccagatcgagcggggcgaaaagcgacggatagcggctcataatctcttccagtgtaaaattattgttatgtggtcggatgagttactaatttagccagcgcgggggcaaaggtaaaagcgggatcgaatgattgtgatagaactcaaagaacttccccggtggcgctgcgcttaccggggctacgcttaccggggctacgaaaccgcagaaaccccaggccgaataagcgcagcgccatccggcatgatttaaggcgccgttgcgcgcaccagtcccggcgcctgccacatcgaggtggtcagcccgctgtccaccagcccaagctgatccgcatacaccgcctgccatttctgcatcatgccgtcatacagctcccggtgtgccgggttgggcgtaaattcccggctccagctcaccagccgctcgccggtggcggccatatcgtcgaacagtccggcgccggtacccgcggcgatggcgcagccgagcgcggtggcttctttcacgtccggcacacgcaccggcaggccggtcacgtcgcttaaaatctggctccacagtgcgcctttcgcgccgccgcccgcaaataccagcccatcaaaggtgacaccggagaagcgggagatctgcgccaggttgcaggcggaaacaatagctgcgttctcctccagcgcgcgaaacagcgtggctttattgcatttttccggatcgatggagaggttaataaacgacggcgcggcgtgataccagtgcttaaaatgcatggcgtccgagaaaatcggcattacgccgtgggagcctgcagggacgcggcccgccatctcttccatcagcgcataggcgtccatccccatgcgttcagcgatcagcttctcctcggcgcaaaacgcgtcccggaaccagcgcatggtcaggccggtgaaaaagctgatcgactccgcctgaaccatgccggggatgacgtgcggattaacgcggatattcatatcgggatcggtgcgtacctgcggcagattgaccacctgctgccagaaggtgccgccgagcaccgccgtctgcccggcgcgcaccacgcccagtcccagacagcccagctgcacatcgccgccgcccatcaccaccggcgtgccctcgcgcaggccgcactgcatggcggcagaatgcgtcaccgcgcccagcacggtgccggtctcttttacgggggagaggatatcggcgcgcagcccggccatatccagcagcgccggacgccagtcgcgtgagaaaagatccagcatgccggtggtcccggcgttggaaggatccaccgccagttcgccggagagttttgccgccagccagtcgctgatcatagtgatggtcgccgcctgacgataaatatccggccggtgatgcgccagccacaacagacgcggcatggcgctcagcgccagcgtctgcccggaaacctcgtacacttccgcttcaaagcgatcgtcatggatctcttttaattccgccacttcgcggctggcacgggcatcaacgttggcgcaggcccagatcgcctcgccgttgcggtcataaagcacgataccttcgcgcatggagcagcaggcgacggactgaatattagcgccggtcagctgcgcccgcgtcagcgcctggtgaatgcactggcaggccagctgccagttggtggtgagatcgaactccatcgagccgggcacgttctccacgctcaggtgtttccactcggcctggcctgcggcgatctgccgcccctgtaaatcaaaaattaccgcgcgaatgctgccggtcccggcatctaaggctaaaagataactcatgagcttgcctcgctgttggcgcgcggcaggccggaattactccgccagtgccaggatcgcgcgtgctgtcgtctcttccgtcaccaggccattgatacggcgacctttgagtgcggcataaatcgcctctgctttttcgatgccaccggccgcgccgacaatggtcggtaattgcgccagttcatcgagggtgacgccgagcagttcccggtggatgtcgaggttttccacccgctcgccgtctgcctgcaagaaataccccagaatatcccccaccgcgcctttgcgggcatacatcagctgttcgccttcgctgatatagccggagcgcataatggtggcgtcgcgtttctggttgaccgatccaatgcccaccacggcgacgtccgcggcagtggcggcgaggatcacatcccgcacgctggattcgcgttttaagatctccgccacatccgccgacgacacccgcaggggggccgggatcatgctgatgctacaggccgcgtccagctggccgatgccggtcatatacggcccgacgccgccggacagcgtcaccaggcggatctgctgtgagctgataaaaccgctcagatgctggatacagctcatggtggtttcgccaaagcccaccgccagcagctgccccggcgacagcacgcccatcagcgactgcgccgcgccaatccccagccgcacgctcatggcgggggtattcagcgcgggcagcacgcgggtgatcttcagcccaaaccgctgttgcagttcggtttccagcgccagacagccctcataacgggaattgatctgcacgcggatcacgccggactgccgccccttttccagcaggcgggagatcttcagccggggcagccccagccgttcgccaatatcattttgcgttaagccatcgtggtagtagcaccaggccacccgcgccaccagctcttcctccgataacgtcagcccggcaaagcggctctcatccgtaatgcgtttttcgctcatatgatgaactcttataaaattttagatcaaatgttctcatgcgccgctgaataaaatgtgagcgcgatggcaaaagcgatcttttgtccctgcgcaaaacaaagcaacgatccgaatgcaaaaaagtgtgatccgggcacgggtattaatatagctcaccgtctacgctttttgaacattgtgaatttttaaaatcatatgttcataaccggagccagaatgatccctctcattgaagcccgtgacgtccgcaaacagttctccggcgtgcccgttctgaaaggcattgattttacgctgcttgccggtcaggtgcatgcgctgatgggcggcaacggggcggggaaatccacgctgatgaagatcatcgccggggtggaaaccgccgacagcggcacgctgcacatcaacggcagtgcctaccgccgcctgacgcccggccaggcgcatcagctgggcatctatctggtgccgcaggagccgatgctgtttcccaatctgacggtgcgggaaaacattctgttccgcctgccgcgcagcgggaataccgatgacgtgctgaatgaaaaattacagcagctcaactgccagctgaatttgcaggccgccgccagcacgctggaagtggcggatcagcagatggtggagattctgcgcgggctgatgcgtaacgcgcgcattctgatccttgatgaacccaccgcctcgctgacgccgggggaaacggatcggctgttccggcagatccgcgccctgcaaaggctcggcgtcggcatcgtgtttatctcccacaaactgccggagatccgcgccctggccgacagcgtctcggtgatgcgcgacggcgcggtggtgctcagcggcgcgctcagtgaatttgacgatcaggcgttgataggcgcgatgaccccagccagccgcgcccatcatttaagcgactcgcaaaagctgtggctcgcattgccgggcaatcgccgcacccagccgcaggattttccggtgctgcgcgtggaagacctgaccggcgaaggctttatcgatctggatcttgaggtgtacgccggggagatcgtcggcctggccgggctggtaggatccgggcgcaccgaatttgccgaaaccctctacggtctgcgcccggtacgcggcgggcgcgtatggctggaaaatcaggagatcaccagccgggatacggcctcccggctggcgcgcggactggtctatctgccggaagaccgccaggtgtccgggctgttcctcgatgcgccggtgcgctggaacacagtaacgctcaacgaaccctccgtctggcagcaaaaaagccgcgaagcggcggtggtggagcgttatcaccgggcgctgggcatcaaacttaacaacgccgatcagacggtgcgtactctctctggcggtaatcagcaaaaagtgctgcttgcccgctgtctggaggccaatccgctgctgctgattgtcgatgagccgacgcgcggcgtcgacgtttccgcgcgggcggatatttatcagctgctgaaaagcgtggcggcgcagaacgtcgcggtgctgatgatctcaagcgatctcgatgaattccccggtctggccgatcgggtggtggtgatgcatcaggggatgcgcagcggtgaactggcgcagcaggcgatcaatgtcgatcgcatgatggcgctggccttcggaggacaggcatgaagaccttacttaaaaaccgcgagctgagcgcttttctggcgatccttgccctctttgccgtgctggtggccctcgatccggcctacctcagcctgcaaacgctggggatgatttttgccagcagtcagatcctgatcctgctggcgctgggggcgacgctggtgatgctgacgcgcaatattgacgtctcggttggctcgacggtgggcttaagcgccattgccgtcggggtggcgctcaataatggctacggcctgccgctcgccatgctgtttgccctgagcatcggtgcgctggcgggggcgttcaacggcctgctggtggtcgggttgcgcattccggccatcgtcgccacgctcggcaccctcgggttataccgtggcgcgatgctgctgtggaccggcggtaagtggatcgaagggctgcccaccagcctgaaatcactgtcggtgccggtggcggcgggcgtgtcgcccctcggtctgctggtattagccgtactgggcgcgggggcctggtggctggcgcgcacggcctccgggcgggatttttatgcggtaggggataacctcgcggctgcacggcaactgggcgtggcggtcaaccgcacccgtatgctggccttcaccttaaacggcgtgctggcggcctgcgccgggatcgtctttgccgcgcagatcggttttgtgcctaaccagaccggcagcgggctggaaatgaaagccatcgccgcctgtgtgctcggcggcatctcgctgctcggcggcaccggcacgctgatcggcgcgtttctgggcgcgttcttcctcacgcaaatcgataccgtgctggtgctgtttaagcttccggcctggtggaacgactttatcgcggggctggtgctgctgggcgtgctggtgctggacgggcgtctgcgccaggcgctggcccgtcatcagcgccagctcaaatacagccgttttcagccgggccacaaggggagtaagcacgtcgcccgctttccgcatcgcaaaaataaagaggtggcgtaaatgaagctcaactgggagtggtcgctgctcggtctgctggtgctggagatcgcgctgttcggcgcgattaacccgcgcatgctggacatcaacatgctgctgttcagcaccagcgactttatctgcatcggtatcgtggcgctgccgctgacgctggtgatcatcagcggcggtatcgacatttccctcggctccaccattggcctgtgcgccatcgcgttaggggtgatgatgcaggcgggctggccgatgggcctcgccatcgtactgacgctggcgctgggtctgctgtgcggcctgctgaacgctgcgctaattcactataccggtatcagcccgctggtgatcaccctcggcacgctctatctctacggcggcggggcgctgctgctctccggcatggcgggagcgacaggttacgagggcatcggcggtttcccggacagctttaccgccttcgccagcctgacgctgttcgggctgccggtgccgctggtgctgttcggcgtgctgacctttgccttctggctgctcgcccatcgcgggcgtttcgggcggcatttgtttttgattggtcagaacccacgggcagcacgttatgcggcgctaccggtgaacggtatgccctacgtgctgtacgggctggtgggggtggcgtcggcgattgccgcgctggtgctggtctcttacttcggatcggcgcgctcggatctggggcgcgatttgctgatgccggcgctgacggcggcggtgctgggcggcgcgaatatctacggcggatcggggtccattctgggtaccgcgctggcagcgttgctggtggggtatctgcaacaagggttacagatggtcggcatccccaaccaggtgtcgagcgcgttgtcaggtgcgctgttggttgtggtggtgatggggcgttcgctgagcctgcaccgggaatgggtgcgcacggcctggcgtcggcttctctcgcgaaaaacaatcggagcataagatgaaagcaaaacagatagtgcagcttagcgcgctggcgctggcaacctgtgtggcaacggcgcaggccgccgaccgcatcgcctttattcccaaactggtgggcgtcggcttcttcaccagcggcggcaacggcgcgaaagaggcggggaaagatcttggcgtcgacgttacctacgacggccccaccgagccgagcgtttccggccaggtgcagctggtgaataacttcgtcaaccagggctataacgccattatcgtgtcggcggtgtcgccggacggtctctgcccggcgctgaagcgggcgatgcagcgcggcgtgaaagtgctcacctgggattccgacaccaaaccggaatgccgcagcatctatatcaaccagggcacgccggaacagctgggcggcctgctggtggagatgaccgaaaaacaggtgacgaagcctgatgcgaaggtggcgtttttctactccagcccgacggtgaccgatcaaaaccagtgggtgaatgcggcgaaagcgaagatcgccaaagatcatccgcagtggaaaatcgtcaccacccagtttggttataacgacgccaccaaatccctgcaaaccgccgaggggatcttaaaagcgtatccggatctggatgcgatcatcgccccggacgccaacgccttaccggcagcggcgcaggcggcggaaaacctcaagcgtaccaacgtggcgatcaccggcttcagcacgccgaacgttatgcgcccgtatgtggagcgcggcacggtgaaagccttcggcctgtgggacgtggtgcagcaggggaaaatctccgtcaacgtcgccagccagttactgaagaaaggcgatctgaacgtcggcgacacggtggaagtgaaggggcttggccccctcaaagtggagccgaacagcgtacagggctaccagtatgaagcgaagggcaacggcattgtgctgctgccggagcgcgtggtgttcaccaaagataacatcggcaaatacgatttctgacgggggagagcatggcagatttagacgacatcagagaaggtaaaaactttggccttgaaacgccacaacagaatacgctgttcgccctgaagggctgcggcgcgctggactgggggatgcagtcgcggctggcgcgtatttttaacccggcaagtaaccgcaccgtgatgctggcgtttgaccacggctattttcaggggccgaccaccgggcttgagcgtatcgatctgtcgattgcgccgctgttcggcgaaaccgatgtgctgatgtgtacccgcggcgtgctcagaagcgtggtgccgcccgccaccaacaaaccggtggtgctgcgcgcctccggcggcaattccatactttcggagctctcgaatgaatgcgtggcggtggcgatggaagacgcgctgcgcctcaacgcctgcgcggtggcagcgcaggtgtatatcggcagcgaacatgaacatcagtccatcaataacatcatcaagctggtggatgccggtaaccgctacggtattccgacgctggcggtgaccggcgtcggcaaagagatggcccgcgatgcccgctatttttccctcgccagtcgtattgccgccgagatgggggcgcagttcgtgaagacctattatgttgaggagggcttcgaaaaagtgaccgccagttgtccggtgcccatcgtcatcgcgggcggtaaaaaactgccggagcgcgaggcgctggagatgtgtttccgcgctatcgatcagggcgcgtccggcgtcgatatgggacgtaatattttccagtccagcgcgcccctcgccatgctgaaagcggtgaaaaaagtggtgcatgacaatatgagcgcccacgaggcgttcgaattctggcaggaagaaaaacagggagaggcgcgatgaacgtgacgctggtggagatcaatatcaaaccggagcgggtcgatgagtttctggcggtgtttcgcgccaatcacgaaggggcgatccaggaaccgggcaacttacgcttcgacgtgttgcaggaccccgaagtgaatacgcgtttttatatctatgaggcgtaccaggatgaggcggcggtgctggcgcacaagcaaacgccgcactatctggcgtgcgtggagaagctggacgacatgatgtcggagccgcgtaaaaagcgcagttttatcgggttgttaccggagtaaggcgaccctgttcccggcgctgtcaaacagatgtaaatgccgcgcatccgtgctcatggtcagcggatgacgcggcgggtagttcagctgctggaatgacttcaggcagcacgcctgcccggccagcgtaaaccataccagcgtggcatccccctgtaattcacacagccgggtggtggcgctgaaggtgagttcgccgctgctctcggggcggatatgttccgggcggatggcgacgaaaagcgcatcaccctcaagcacgccatcaggctggcgtgacagcggaaaatgcagctcgtcgctgatactcaggccgccatcgcgccattcggcctgcaaaacgttaatttttggcgtgccgataaactccgcgacaaacaggttcgccggggtgttgtagagttccagcggcgtccccgtctgttcaatattgcccttgttgagcaccacaattctgtccgccagcgtcatggcctccacctgatcgtgggtgacgtaaatcatggtgttgccaagcctgttgtgcagctcctggatctcctggcgcatctccacgcgcagcgccgcatccagattcgacagcggctcgtcgaacagaaaaacctccggctgctgaacaatagagcgcccaatcgccacgcgctggcgctggccgccggagagatgttgcggcaggcgatccagcaatgcttcaagcttgagcattttcgcagctccggcgatgcgttgcgtaatttctgcgggcggcgtgttcatgtttttcagcccaaagctgaggttctgccgcacggtcatgtgcgggtaaagcgcgtaggactgaaataccatcgacaggctgcgtctgcccgcaggctggtgggtgacgtcctcatcgcccatcgctatcgttccgccatcgggcgtttccagcccggcaataatacgcagcagcgtcgatttaccacagccggacgggccgaccagcacgatgaattcgccggaggcaatatccagcgacaggttttcaataatggtgtttttgttgtactgcttgtgaatatttctcagggtgagggcggtcatgtgaaatcctttttaatggcctatctgtataagatattaatcgccgttgagcttgttaaaaataatcagatgtatttgtcttgattatatttttgcatttacttttcgccgcaaagtttagcgataaataaaaaccgaaatgtgactgaattatcgttaaacataaatcactcttgttaacttacaggccgtttgccgcgtgcgatgttttatttaacacgcgtcaggaataacatggagatcaggatgaaaagtacaacacttgccacatggaccgcatcactcttattaagtgtttgtcttactggctgcggccctgatgagcagcccgccgacaccgcggcgaaaacgccgattaaattatgggtgacgccagtcgagaacgaagaagccttctggaagaaaatggtcaccgagtggaatagcgatcccactcatacgccggtggaatttacccctattcccgttgccagcagttccgaagaagccattatgaacgcgattgcctccggcactgaaccggatatcaccagtaatatatttattggcttcgcctcacagcttaatgaaattaatcagctggaagatctctctaaaatgccgggctttgccgatcttattaagcagcgccagatggatgacgtgatgcccgcctgggaaattaacggccagcaaaacgtgctgccgatttatatcaatcccacggtctggtggtggcgcgccgatctgttaaaacagtatggtttcgaccaggtgccacgacgttatgacgagctgtaccggctggctgaggcccgccatgcggataacaacggctacgtgatgcagctcaccgccggaaaaaactggtgggagcgctggtacgattttattccgctgctgtacgcgcaaaacggcggcaagccctatatcgcggagaatcaggcgcagtttaataacgccgacggtcaggcggtactgagctttatgggcaaggtgttcaacagcggctggagcagctacgactttacctcagcggaagatccgctggcgagcggtcaggtgctggtgtcggcgcgcggcccctgggacatcgcccgctaccgcaaacagtttcccgagatcttaaagcagatccagattggccccatgctgacgcaaaacggcagcgaaaaaccctatacctttggcgacagcaaaggcgtggcgatgttcagcaccagcaaacacaaggccgaggcctgggcgtttttgcagtgggtgtttggcaaggcagagcacgatctgctgtggctggaaatggtcggtatgccgcccgcccgcgccgatctgctcactaatccgctgtttgtcggctacttcgcgaataacccgctggaaaaacagatcgcctcttatgtgaatgtcgcgctgcccgcggcggcgaccaccaaaaccagcgacattcagcgcagcatgacgcagatgatcgagcgggtcattttccgcaacgacgatccgtcggcggcgctcagtgattccgctcaggaaattaacggcattctcaaaccttaagaggcggcgatggctggacatgacgcacgtaccggaggctggctggcctccgcatggctcgggtattcgctgctgttctggttttatccgctggcctggctggcgctgttaagcgtgacgcagtggcagttcaccggtacgccggttttcacggggctgagcaatctgttcagcgtgatgcaggatgagctgttctggacctcgatgctcaatgtactgcgctttctgctgtggtacatcccgattgtgtttctcagcgcgctgctgttcgccgccgggttaaagcgcatcacctttggccgggggtttatcgcgctgagtttcctgctggcgaacatttcctccggcgtggcctactccattgtgttttcaaaactgttcagcgagttcggcccggtgaacgcctttttacgcgatctgttcggcatttccgtcccctggtttaccaacccggactgcgcgatgctctccattgcgctgatcgtcacctggaaattcgtcggctattacgggctgatcctttactccggcatgcttgcgatcccgcaggacatttacagcgccgcgcggctggataaaaccggccgcctgcgccaggcgtacgccatcacattgccaatgatgaacccgcaaatcgttatggtgatggtgctggcgatcaccgtggcgttcagcatctttaccgagccgtatctcatcaccggcggcggcccgctcaacagcaccaccagcccgatggtggtgatgtacgaagtggcgtttcagaagatgaaaccgagctgggcggcgaccatgtcgattatcgtcgccgcgtgcagttttctgctgatctggctgttccgcaaactctttgaaaagcacattgagatcgtctgatgaaaaaacttacccccgcgagcctgcttctccacgccgccatgttgatcctcgcgctcacctggctgtatccctttatctggatggtgatggcctccctgaaaccaacggcgcagatctacaccaccagcctgtttgccggtgacgtttcgctggcgaactaccagtttctgtttgataacagcaaccgcgccgataagccctttatgcgcacgctgtttaactcgctgttcgtgtcgctgaccatcaccttttgcgtcactgtcaccgccatgctggtgggctatgcggtggcgaagacggattttcgcggcaaaaacgccttcaaaaatctgcttatcgtgcagatggtgtttccggcgtttatgttcatcattccgcagtttattttgatgcgcgagctggggctgattaacagctacagcgcgatgatcctgccctacgccatgagcgcctgggggatctttatggtctcccagagctttaaaggcacgccgaacgactatatccatgcggccaaactcgatcgcgccagcctgtggagcattctgcgccacgtgatgatgccgctgaacaaatcgatcctcgccattgtggcgctgttcaccttttccactgcctgggacaactttctctggccgctgatcgtgatgcgcgatgccgacaaaatgccgttctcggtgctgcttgccaccttcagcaaatcctggggcattcacctcggcccggtactggcgggatccgtggtgcagatgctgccggtgatgctgctgtttattatgttccgcaaatatttcctgcaggggatgtcattgtcactcaaataaggagggccggatggaaccggtgcgctggtggcaggagtgcgtgttttatcaaatttatctgcccgcgttttgcgacggcaacggcgacgggcggggggattttatcggccttgcgcagaagatcgactatctgcatgagttagggatcggcgggatctggatcacgccgttctacccgtcgccgctggtggataacggctatgacatcagcgactactgcgcggtggatccgcgcttcgggcagtttgaggatttcaggaacgttgtggcggcctgtcatgggcgggggatgcgcgtggtgatcgatctggtgctcaaccatgtctcctcacagcacccgtggtttgtcgatgcctggaataatcccgccagccgttaccgggattattttatttttaccgaccagcccaacaactggcagtcgtttttttccggcagcgcctggatgccggagccggataccgggcagttttattaccataaattcgccccgcagcaggtggatctcaactggcagaatccgcaggtggagcaggagatctaccgggtgatggatttctggctggcagctggcgtggatggttttcgcttcgatgtgatcaactttctcactaccgacggcatcggcgcggataacctggaaagcgcaggcgaacaggaacaccggcacgatgtgaaccagccgggactcatggccgtgctgcgccgcctgatggcgtatgcccgcgccagaggcgatctgtttctgatcggcgaaatcggcagcgaggatctggcggtgctgcgccgctatcaggccgcggatctgctggacgtggtgtttaacttcaatctcggcagccagaaaaccttcagcgcggcggcgattttcgccgccttaaccgccatgaatgagcagcagccgggcctgccgacgctgtttttttccagccacgatatgtcgcgcatgatcagccgctttggggaaaacgaacgcgatactgaccgcgcccgcgccgtgctggcgctgcaactcaccgcccgcggcgtgccctttatctaccagggagaagagttcggcctgaccgattatcggccgcaatgccttgcagacatcagcgacgtgcagggcagaacgcattaccagaccgcgctggcggcgggcaaaaccgcagacgaggcgctggcaatcgcactgacgcacacccgcgacgcctcccgtgcgccgctgccctggggcgaaaaagacgcgctgtggaaggattatcgcgagctgatagccctgcgtaaccacatcccggtactgcgccacggtgcgtatacccgcctggcgttaacggatgcctgcatctggttttcccgcatcacggcggacgagcaggtgtgggtggcgattaattttggcgcgccggtgcgtaatccgtggcacgcggtggcaggcgaggtgctctacggcgataacgccccctggcttgggaaaaatcagtttgtgatcaaaaggagaggttatggaaaggcacagtaaaaatccgcttatcacgccggctgacgtggtgccgtcttcaccggagatgaaagtcgagtgcgtatttaacgccggggtgacggagtatcacggcgaagtgttgctgctggtgcgcgtggcggagagcgtgaaatgtaacgatgcaaacaagatcgtcgtgccgctgcttgagcagcagggcggggcgtgggtggcggcgacgcgggcgttcgatcgcgcggatccgcgctacgacttcagcgatccacggctgatcgtacaaaaaagcgatccgtcgcagatctggctcacctccatgtcccatttacggctggcgcgcagccgcgacggcgtgaattttagcgtcggccctcagccgtttatcctcgccgacagccagtgcgaacagtttggctgcgaagatgcgcgcatcacccgcatcgacgacgtctggtatatcaactattcggcgatttcaccgctcggcatcaccacggcgctggcaatcacccgcgattttgtgacggtggagaaaaaagggctgattttctgcccggacaaccgcgacgtctgtttctttccggaaaaggtgggcggcaagtacatggcgctgacccgcccggcgccctgtcattttggcctgccggagatctggatctgcgaatcgccggatatgctgcactggggcaaccaccggcatctgctcgggcgttccggcgatgcgtgggacgcgcgcaaatccggcggcggcgcgccgctgctgaaaaccgatcgcggctggctggaaatttatcacggcgtggatgaaaaccagcgctactgcctgggggcgttactgctggatacggacgatccgctgaagatcctcgccaaatccccggtgccgctgctggagccggtggccccctatgagcgggaaggatttttcggcaacgtggtctttacctgcggggcgttgatcagagatgagacgctgcacatctggtacggcgcagccgatgagtgtattgcgctggcgacgctgccgctggatgcgctgtggcagcatctgggggtgtgaatgtttccctcaccccgctggtatagccgggtgagggggcaaatctcacgcctccgccacgcctacccgcagcgcagccagcgccgcaccggcggctttcagcacctgctcgcactgatcaatctgtagcgtcagcggtggttcaatacgaatggttttcgaattgttcagcgtcccggccaccagtacatgctggcggaacatctcgctggcaaagttatagcccgtctcgttatccacaaactcaatggccatcagcatgcctttgccgcgcacgtcctgcaccagatccgggtattcacgcgccagcagacggaagccgtccagcagcatgtcgcctttctgctctgcctgcgccggtaagttctcttccagcagcacgttaatggtcgccagcgccgcggcacaggccagcgggttgccgccgaaggtggtggtgtgcaggaagggattatcaaacagcacggagaagacttcttcggtggcgatggtggcgccaatcggcatcacgccgccgcccagcgctttggcgagacagagaatatccggatggacattttcgtgctcgcaggcaaacattttgcccgtgcgtcccataccggtctgcacttcgtcgaagatcagcagcgcgccgaactcatcgcacagcttacgcaccgcaggcagatagccgaccggcggcaggatcacacccccttcgccctggatgggttcaaggatcaccgccgccacgtcatcgccggttttgtggcattccgacagcagcgtgcgcatggcctcgatgtcgccgaacggcacgtggcggaagcccggcagcagcggcataaagggtttgcggaaggcggatttcgccgtggccgacagcgcgcccagcgatttaccgtggaacgcgccgctggtggcgacaaaggtaaatttaccgcgcggggactgatacgctttcgccagtttcagcgccgcctcaacggattcggtgccgctgttacagaagaagctgtatttcagttttcccggcgccagcgcggcgagggttttggcgagcatcgcccgcagtggatcaagtaattcctggctgtgaaggggttgtttggcgagctgatgctgtacggcggaaacaacgactggattacggtgccccacgttaaaaataccaaagccacccaggcaatctaaaaactcctgtccctgggtgtcgacaagcgtattcagacttcccgcttgccactctacggctccgtaatccccgcctgcggtgacagattttcgatactctaaaaaccccggattgacgtgctctttaaaatattcaatcacctcgcgattcagatctttcatttcgtcatgagaaagcgtggccttctcaataatgttaagggcatgtgcgctacaggcaagagccgatgcgctggaaggtaacctgttcaaaatgagctcctgggagtggcgtatcacgcgatacacaaaataattattgcagggattacgccacttcagcaggtgcgctgaaaatcgggataaacaccaggtggaaccgcgatcgcgcaaaatttaatcgtccggcggggcgattaaactcttttcctgcggcggtaaaaagcggtctttggctgtactttcgccgatattgcgcagatatagtgcagattttgcctctttatagggcacaggcaaaaagggagtagaagtagtttcttgatgaaaatattagaaaatcaatgacctgcatggcatgaaattaacagggttttagtgcgatttgcgatctaaatcaaatttaacaactaaagataaactcattagcgccgaaataacatttgccagaaaaattaacagccagataactctgcaaaggacgctttcatgcctgctcaaccctgggtcagtcagcacgagtatttactcgatgatgacaccaccctgatgtccaccaccgatcttaacagttacatcactcatgcgaatgacacctttgtgcaggtcagcggctatgagttagatgagctgatcggccagccacataatcttgttcgtcacccggatatgccaaaagccgcgtttgcggatatgtgggccaccctgaaacgcggcgagccctggagcggcatcgtgaaaaaccgccgcaaaaacggcgatcactactgggtgcgcgccaacgccgtgccgatggtgcgcaacggcaaagtcaccggctatatgtcgatccgctcccgcgccacgccggaggagatcgccgccgtcacgccgctgtacaaggcgctgaacgaagggcgctgcaacaagcgtgtggataccggtctggtggtacgcaaaggctggctggggcgtctgcccgcgatgccgctgcgctggcgggtgcgcagcgtgatggccgggctgtggctggtgctggcggcggccatggccttgctgcatgccggctgggcggtgcagctggcggccgcgctgatcttgctcatcggctgcggcatttttgaggcgcagattgtgcgtccggtggaaaaggttgcgcagcaggcgctgaaggtggcaaccggcgagcgcaacagcgtgcagcaccttaaccgcagcgacgagctggggctgatcctgcgatccgttggccagcttggcctgatgtgccgctggctgattaacgacgtggcgcaccaggcgacagaagtgcgcgacggcagcgaaaccctggcgaaaggtaatgacgatcttaatgaacgtacgcgccagacggtagtaaacgtacagcagacggtgaccaccatggggcagatggccgcctcggtgcagaataactccgccaccgcagcggcggcggataagctctccatcgaagccagtaacgccgccagccacggcgggcgggcaatggacacggtggtgaaaaccatggatgagatcgccgacagcacccagcgtatcggctctatcacctcgctgattaacgacatcgccttccagaccaatatcctggcgctgaacgccgccgtggaggcagcgcgcgcaggggagcagggcaaaggttttgccgtggtggccggggaggtgcgtcaccttgccagccgcagcgccagcgccgccaacgatattcgcaagctgattgatgccagcgccagtaaggtgcagtccggctcgcagcaggtacacgccgcaggcgccaccatggataacattgtcgaacaggtgcagaacgtcacgcagctgattgcgcagatcagccactccacctctgagcaggcggccgggctgtcggatctgacgcgcgccgtggcggagctggataccatcacgcagaaaaatgccgggctggtggaagtgagcgcccaggtatcagcgatggtcaaacagcgcgccagccgtctggaagaggccgtcaccgtccttcattaagtcattcccctcaccgcttttctgcccgcagagaagcggttttttatcccctgatggtcttccctcctgttagcctcatgtaaattatatatttaaatattgttaattttatattaaaagccgaatgctttttgatcgaaatatatcttatttacggatcttcattaggctatttttcgaataacagcaacctgtcggagaatattcttttcgtgcggtgataaataaaaaaccgatcaaactcataaagttagcgaagccgttaccgataacgtttcctgtgcgtagccatttacaaccagggaaaaaatatgttcttacatgatgttaagatcggcacaaaattatttctggcgttcggaatttttattgtgttgatggtggtgagttccggtctgtcgctgttcagtctgaatcgtgccaacaatgggatgcaggacattgttaatcgtgactatcccacgaccgtgaaggccaatcagttgattgagaattttcaggagtttgtcagcacccagcagctgatggtgctggatacggacgggaagtggagcgccgaatcgcagaagcatctgaccgccattagcggcaacattaccgtgttgctcgacgacctcagcagcgccctgcgcgatcgcgagtcgcagcgcatcctgagtgaactgcgccagatacgccagcagtatctggattcgcgtttccgtattctcgaggcggtgaaaaataaagatactcacgcggcggtggaagagatgatgaacaacactctgccggtacagcgtgcctacaaagccaaagtgcaggagttgattgccgttcaggacaacaatatgcgcagcgccggaaagctggtggagcatgattttaaatccaaccgcaccctgctgatcctgctggcgttgatcagtattggcgctggcagcctgatggggctgtttattgtacgcgccatcacccgtccgctggtacaggcggtgcagtttgccgaagccattgctggcggcgatctgactcagcatattgacgtaaaacaccgggatgaaaccggcgtgctgctcagcgcgctggtggcgatgaaaacacgcctgtatgagattgtgcaggaagtgcagaacggctcggagaacatctccagcgccgccgcgcagattgtggccggtaaccaggatctggctgcccgcaccgaagagcaggccagttccgttgaacagaccgccgcctctatggagcagatcactgccacggtgaaaaacaccagcgaacacaccaccgaagcgacgcagctctctgccgaagcggcgacggtggtgaaaaacaacggccagatgatgaagcaggtgaccgagaaaatgcgcgtcatcaacgacacttctgaccgcatgtccgacatcatcaacctgatcgattccatcgccttccagaccaatattctggcgctcaatgcggcggtggaagcggcgcgcgccggtgagcacggacgtggctttgccgtagtggcaggggaagtacgccagctggcgggcaaaacggcgtcttccgccagtgagatccgccatctgatcgaaagctccaccgcccaggcccgcgacggcatggcgctggtggaaaaagcgggtgggctgattaacggtatggtcagcaatgtggaagagatggacaccattctgcgccagattggccacgccagccgtgaacagacggaaggcatttcgcagatcaacagcgccattggcctgattgactccaccacccagcagaacgccagcctggtggaagagtctgtggccgccgccgcgtcgctcagcgatcaggcgtcgcacctgaaaggtctggtcagcgtgttccgcgtgcgccgggaggcgacggcttaatccagctgtgaaatctccagcgccgcacggtcgatcaccgcgatgatctgttcccgctgtgcggcgctgacgttttcctgattcactttccgatccagcacggctttaaagttatccagcgcgcgtttcatctgcggatcctgacgcagcagatagccgacgctgcgggctttgatccgcgcctggatctgaccgagctgttcagcgttttccgccagccactgcgttccggctgcggtgatagcaatctttttccgtccgccgtcttccccgatcgcgataagcgcctgttcctgtaaaaaatccagcgtcggatagatcaccccggggcttggcgtgtaatgcccgagggtaagctgttcaatggccttgatcagctcgtaaccgtggctggcgttgcgggacagcagatccagaatgaccagccgcagatcgccatgcccgaaaaagcgcggacggcggctgccgtgctcgtgatgaccgtgatcctgtggatgcctcatcgcataatccctctgaattagatatatctaattttgcttgcgttcctgctaattagcaatcattatcatttaaaaaccaaatcagatatatcgtttttaacgtgacgaaggctaaataatgaccacatcacatcagcgttacccgcagcgcgtgcgcaatgaactgcgctttcgtgaactgacagtattacgagttgaacgtatcagcgcaggttttcagcgcattgtgctgggcggcgacgaactggcgggcttcagttcgcaggggtttgacgatcacaccaaagtctttttcccgcagccggggcaaaaagtggtgccgcccacggtcaccgaagacggtatcgtctggccggacggcccacgcccggcggcccgtgactatacgccgctgtatgacgcagaacgtcacgaactggcgctggatttctttatccatgacggcggcgtggccagcagctgggcgctggaggcgcgggaaggcgacaccctgaccatcggcggcccgcgcggttcgctggtggtgccggaggattacgcctggcagctttacgtctgcgatgagtccgggatgcccgcgctgcgccgccgtctggaagccatcagcaaaaccccggcgcgtccggaagtcaccgccatcgtgactattggcgatgaggcgtataaggattatctggcgcatctggacggcttcaatatcgaatggattatcggtcataacgaggacgtactggcgcaacggctggcgcaggtgcgcgtcccggcgcaggactattacctgtggatcaccggggaagggaaggtggtgaaaaacgtcagccagccgttcgaaggcggcggggttgatccgcaactgatgcgggcggcagcctactggcacgccaaataatcaggcgaccgcgtcgagctgcgcttcgctcacctggcgctccagcgcggcgcggacttcgctgagcgctttttcctgctgggtaaaataagcgtccatattgctgagtgatgacaccagcagccaggactcctctttttccagctccgccagctcggcgaccagggtgtcgatttgttcacgtacctgcgccatctttttgcggatacgttccagatcgttcagccggtcgctggccatcatcggctcaaagccctgatgcagacgcgccaccagcgagcgaatggctttgacgtcgccgcggtgtttcgcctgattaagctgcaccatcatggcgttggcttcatctttcagttcatctgccaccagatccgggtgacagagtttactggcctgacgccacagccgtttcagttcgctttgatcttcttctgacagctggcggccttttcggaaacggatctcggcgtcgtgctgctgctcgcggtatttttcgtactcgtcgtttgcctcgtcacaggcctgacgcgcgggctcttcttcccgcgttaagccggtttccagctcctgcgcttccgccagcagattggcgatcagatcgctttgctgctggagctgtttgcgcgcctcgacagattgcaccgaatcggcgggcagctcgcgccagcgttttgtgagcatcgccagcacgtccagcgcctgcgccatatactgctggcagcggcggtagtcctcttcccgacgctgccgctccgccagctggcggcgcaggttcagttccgccagatttttacgcagctgaaggatctgcgtcatcagcggcccgagacggttcagataaaggtcattaaattcatctaactgctgaacgcgggcattgcggcggtcgatcagatcgcgcagccgctcctccagcgctttgagttccagcttgctggccgccacctgcggatcccgccactgggtcaccgcgcgctggctttgcaaccaggcggtgatcgccgtcatggcggcggtgtaattcttttcctcaagcgccgcgacaatcgccagcagctcatcattgaacgcttcatttttcagccgtgcgagctgactgacaatgatgtcgtcatcttccagttctatggcatttttgatgatttcaagtcgtttgatgggtgtgctcatgatgcctttcgctttagcgcttaagtatttgagttaaggttagttatcagcagagctaccggaaatcatacacaggtctgataaatggtgcgaggggcattaggcgggtttgcggcgggtgacaggcctggcggggagttttcctgcagaaaacaaaacccaccgcagtgggttttgctgacaacccttattgcttcggaataatgagcacctggcccggataaattttgtccggatggctcagcatcggtttgttcgcttcgaagatttggttgtacttgttaggatcgccatacacctgtttggaaatggcgctcagggtgtcgccggatttcacggtgtagtaggtggcttcggcggcggagtcggtcactgagacgttattctccacgctgccaatccccgccacgttacctacggcgacctggattttttctttctgctcctgggtcaggccatcaccggtgaccacggccttgccgttttccaccttgacgctgactttatcggccccgggaacacctgtttttttgagatgctcttcaagcttagtgccgtgatcgctgtcgttgcctttcagtgaatcccataacttttcgcctgcatctttcacaaaatcaaataaacccatggtttctctccagttcaaaagaccttttaatcctggcaaaggcggcagaaagtgccagttttggttaaagaaagcagacttgcgacctggggcgcgctaaaaaatagtgcgccgtcgtgcggctatgatacaaagtacccatcattttatgtgcaagtaccagaacggatggcggcgtctgtcccgatggctcatattcaggaacacgctatgggttattccatcgacatcatctcttgtatcaccgaccgcttcgtggaactcaccaccactgaaaagcgtatcgcgcagtttattctggatgacgtacagtctgccgccacgctgccgatcgcggagatggcgcgtctgaccagtaccagccaggcgtcgatcacccgtttcgcccgcgctattggctgcaaagatgtgcgtgaactgaaggtgaaactggcgcagtcgctggcggtcggccagcgttttattatcgacgtgccggatctggaaggcgtgcagggaatttacggcaccatcattaacgtgctggagatgaaccgtcgcgcgctggatgcggcctcgctgaataaagcggtgggctggctgagcggggcgcggcagatcctggcgttcggtatggggggcggctccaccatctgcgcgcaggaactccagttccgtctgtttcgccttggcctgccggtggtgagtcagaatgacgggctgctggtgcgcatgatggcggcctcggtgtcgcctggtgacgtggtgatcgcgctgtcgctgggcggctttacgccggaggtggtggaaagcgcgggcatcgccagacagtatggcgcgaaggtaatcgccatcacgccggaagcgacgccgctggcgcagctggcggacctggtgctgccgctgattgtgcgtgaaaacgactacatctttaagccgagcacatcgcgctacgccatgctggcgatgatcgacgtgctggcgacagaattagcgatggctaacaaaagccaggcgaaagaccgcttgcgcagaattaagctggcgctggacagccatcgcggcggcgcggatcggcaaccgctgggggattaacccaccagccgattgtgtaatattccaccaagtaatggtgggacattgatgcggtgcagcagtcttcctgaaaggcctgatcgtctttggactattactttcctgtataaaacgggttgtggcagcacgtcaaaataaataatgcaattaataactaatgcaaatgaatattaactgtcaggataataaatacagcgatggtatttgttttatgaatatattaacggaagtaatgattacctaaatatattcctaaaaacacgcggctggctctttttgtagagaacttttaatttcatcaatttttctaatcttttgttttaatatgttgtttttccagcatttttgcggccattgcttgtgttgatttgaactaaaataaactatatcatataaataatatcactcgtcctatcgagcaatcatcatttctaatattgcaataacgatagcttcatctaataatcccctccaggcacaataagcatctcattttatcagtgcagtgaagcgttgtgcttttgtatacccgacataatgcacggaagtgtatgtgaactaacatataatggagttatgaattatgcgacattcagttattaagatggctcagattgctgtgctggttgctggtggtttggggacagtaaatgcgatggctgctgatggccaaattcgtattaccggtgaagtcattaataaaacttgcacagtagcaatcaacggcgcgccgtcttctacattgttgaatatcgatccggttgctgccgtcgatctgaataaagatgttaagtccgctaaaggcacgacttataaagcatctcgtgatatgcgtaccgtaaatattactctggaaagctgcgtcctgcctcaggggaaaactaaagttgcggtcagttttgattctactggctatgcggatgcgggcaccagcacctatacaaatagcctgctgaattctgtgaataccatggatgttgccgcgaaaggcatccagatcggtttcactaaaattaatggcagcgatctgatgatggatttgaacggcctggatgatactgcagattataaagacaccaattcaggtgcgcagacctacagtttcgaaactcgctacgttcagacggctgctaaagcagaagatgtcaccgccggtgatatcgaaacggtagccactttcagcgtcgtttatttgtaattatttactaaatctaaggcggtaagtcttattgccgccttgttttttcagagagcaataaattaaatgtcagttaaatatttagctacaattgtggcagcgatgctggccgtgagcgcatcagcatgggcagatgttgtcattaataccactcgagtggtctataaagaagcggccaaagaagttaacgttcgcctgactaacgagggcacgcgtccgctactggtgcagtcatggctggatgatggccgtgcgaccgaatcgccggaaaatattgatctgccttttatgatcacaccgccggtctcacgcattgatgcgaaaaaagggcagacgttacgtatttccaaaatggccgccaattttcccaaagatcgtgaaagcatctactatttaaacgtgctggaagttccgccaaaagcaaaaggcgaggcacaagcgagcaacaaattacagctggcattccgtacccgtattaagatgttctatcgtccagaggcgttaaccgtcaaaccacaagacgcggcggcgaaagttgaatggcgtgctgaaaatggtgcgttaattgcaaaaaacaactccccttattatgtgacgttcaacatgatgaaagtcggtaataatatggcgaagtcaggaatggttgcgccttttgcaacggaaaaattcgagtttgataacaaagcatttaaaccttctgcgggagccagcctggcctatagctatatttctgattatggtaatgatgtagagggtactgctgttatcaaataatatttcaattacaatggattgttcaggttttttctatggatatgttagttagcgaacgttttcgtttatcacgtattgctggcgcattcattttaatgaatgttgccggaggagttttcgctgcggaaacggaaacagttgagcaaaatagtctctcacctgcatcatcagtagaaaattcgaatgcgcagcaagagggtgaaagtaaagaaagtgaaatagcgggaactgaagatgaagaggtggaattcaataacatctttttatcaaattccccaattgatgtaagccgtttttccaaaggaaaccctgtcactgccgggaagtataatgtttcggttgtacttaacgagcgggaaatggggaaatttgaaattcaatttgatgataacccgcaagatccgttaagagcgctgccctgctttcgcctgaaagaactggctaagcttggcattgatattggcgcaattaatgtctctggcatggaagaagaaaactgcgtttcgctgaagacgctgataccacaagccagctggaaaatggatattaacgatcagcgttttattctgactattccacaagcgatggaacgggcaacccgccctgatgaagtgccggatacgctctgggacgatggcatcaacgcggcctttgtcagctataacaccagttattatcgctcgagctatagcggcgttgagtccgacagcggttggatgggcctggatggcggtctgaatttactggggtggcgtgtccgtgtccgtggcgatgcgaactacgcaaaagagagtggcaccacgtttgacagttcaaacctgtacgcggagcatgatgttgcaccgcttaaatctcagttgcgggtaggtgagatatacagcagcagcacattttttgatgcgtttccattacgcggcgtgacgctgagcagcgacacgcgcatgttgcccgactctctgaacagcttccgcccggttattcgtggggtcgcggagtcgaatgcgaaaattatcgtcagtcaggcaggcactaaaatattagaaactaccgtgccgcccggggcgttttcgatcgataactataatccgatcagctccagcgaacagcttgacgtcacgatccaggaagcggatggccggacgcgtcagctaattatcccatacaacggcggtgggcaattgctttacccgggcgtcagcctgtacacgctggcggtgggggaatatgacggcgcgagcagtagcgataaaccggtggtcggccagggtacctggcaatacggtctgaataactatctgtcattgtatactggtgctgaatatatgtcggactactactccgttattggcggggtggcgctgaatacgccggttggcgcagtttctttagatttgactcagtcgcatttgtcagcagaagacggcagccggaaagggcagagtctggggattaaatacaacagctatattactccgacgaataccagttttaatatcgcggcttatcgttattcgacaaaagatttcttcacgctgggtgaggcggcagattatctgtcgaataccgactggcaggacatggacgatcggcttaaatcacaggtgcagattaacgttagccagaccctcgaagcgggatggggctcgttttattcttcagcaatgttatcggagtactggcgttcagggcgtaaagagaaaagctatcaactgggatacagcaactccctgggccgggtcagctatagcgtttccgttaaccgctattacaccggcgataacgagaaggacgatcagctctatctgtcgttatctgtaccgctcggcgatcgcgccgaggataaatcgccgctgtttgattatctgaacaccagttatacccgtagcagtaagggagaccgcaatttatcggcttcgacttcaggttataaccaggacgcgggtctgaactacggcgtcaatgcgaattatcgtcagaacggctatgacgggaataagattgagaatatcggggcgaatgcttcgtgggatacccgttatggtagctggggggccagtctttctgccgatacagagaacagccgccagatgtcggtgagcggcagcggtggcgttttactccacaagggaggaataaccctcgggcgcaccatcaatggtgacacgcctgttgcattaatcgaggcgaaaggtgcgaagggcgcgcgtgcaatgggggataacgcgtcgcgaattaatagtgccggctatgcctatgtctctaacctgtcgccctatcgttttaatgatgtgagtatcgatccctcgaaaatggaacaggatacggaattaaaagagacgtccacccgggtggtgccgcgtgccggagcagttatttatgtcccctttgccacggacgatcgtcgctcggtatttttccacctgaagttgaaaaatggcaaaaatattccgctgggggcagaggtggtcgatgattcgaataatcagttaggtatcgctggacaaaatagtcgaatattcacccgtggcattgctgaaaaagggcgtttaactgtcaaatggggtgaagatatgagtgaacagtgttcttttaattaccagttacctaccagggacgatattaagttacgaacagatacgttatcagtcgataatattaattgtgattagttattatagaaaaggagagctatatgtttttaaacaataaacagacagtaagggtgcttactgttatggctggagttatggggttcggacatcaggcgatggccgcaacgagtacgctggatgtaactgctcaggcatatattgaaaaaggtacctgtacgtttaaagtggataatcagtccgccacgagcgttccttttgcctttaataccgtcacaccagcagagattgaagcgcaaaataaatcagttgaaaagaaaattgtcatctcagattgtgtgggaacgtcgggaatgaacatttccctgtcgtcatcaaataaagttaaaatcaatggcgataccacacatgactacctccgcccagctaatgtggcggtgaaggtagcatataaaacggaagttaaaaccgagggtggtaactatgttccgctctatgttggggcaccatcaatcagattgggtggcaatttcgagccatttggacaaggtaaaacgggtaacctgtatattaaagccacgctgatccctgcagtggctgatattatgacaattggttctggaacactggactcaacagcaacgcttaacatggactttttataattaaggatgattatgatgaaaaaagtactggtacctttaatttttttggcaccttttgccgcccatgctcttaatgacgctagcctgacacttaattttaccggaacgttaactttaccaacctgcacagcgaaatttgatactaatgcgaccagctttaatatcgactttggtaacgtaaagagtagtgacgtcctggcttcggcaagccatgggggttatctggtacccaatacagtctataaaccagttaaagtaaaatttaccgcatgtggtgcatcaacaaagtttgttgtgggtctgtcctccgctaaaaataacactgacggtacaaattataagaataagtcgcttaaaatgttcacttctgcggcgacaccagctgcgaccgggttaggcgtggccttctttaaaactaatcaagacacctcggaaacgaataccctgccaaccaacggctcgaccgtgagtatggctttctctggtaacacgacgggcgatgccaccaacggttatgtatggacaacctatgcaggattagtggcaattgatagtgctaagctgacgtcagcggccatttctgggtatgctggcaccacgctgaaaacggatggcgcaataaatatcgactatctgtaattaagatacgcggagcctgtttaaagctccgcgtattgatagcatggacagcgttataagttgatggaggaacccatgacaaaaaatgcatcattattatacttgttgatttgtggaatgagcatgtgcggttttcctcattcagccatggcggatgataaggttgatgcagccaatatggggctgcagtttagtggggagctaattaacacttcctgcacagtaacgtttcccagggatacgctaataatggaggccgtggggatcgataaatttacgcagcccggaatgacctcagcctataagcaaaattttcagctcatcattaataattgcaatctgtcacctgccgttgtcagtgatatacgactttcctttagtaccctcgatggtcagggccgtgttgcccccggagcgtttagtaatcaacttccgggtggggccaaaggcattgggtttgcggtctatgaccagcgtgataatcaaaatgtattaacggtttcgggagaaagcagagtgttaaactatccggttaatagtagcgctccgctggatattccgcgtgatttttacattaaatatatacaatccggggccgatgtcaccgctgggcagatctctgcaacattgttagtgagtgcattttatgactagtcaaatttatgacaataacggcctaaaaaagcacatcatatttattctaatggctaggatgaaaatgaaactcaaatggtttttacctgttttactttatctgtttaccgggcattgtctggctgctttgcagacgacatatataatggatgcctcttttgctggtcaatccgatttatcaatagcggcaacgttcaatgtcgatagcgcttccatcccgaatatgggcgggggggtgaaagttatgcaggagaaacaacttcctcctcctaccacgggaattgaatataatcaacgctctttatggggtgaccgcggtaatggaacctggcgctgggcaagcagttccccacttttgactgcgtcctatgacagtaacaatgttgataccactcaaaccaggactgttgatggtaaaacttattataaattaagaatggctgacagcgagagatttcctgtttacgtacggcttgaacagaaagtcttcttgcctgtaaagaacgcttattcttatgtcgatctgaaggacgtagagaatcaatctagacaacatcggggctctttcttttttaacaccattttccagaatagttatcttagtggatgtaataacgcgcagggaaacttcagtgtcactcttatttgtgtacgagatttgtattacgaattaagttcgcaattcgcgaaccgcgatgtgaaaatgtatttttacatgcccaaaaccccgttatatcccattaattttgacaatattttcgtaggttctgtcagttttagtcgcgtatgtatggttgctactggtggagacgaaagcgctgcttttatagcggccaataattgtacaatgaattccaaaaaagccgtcgtatccagattttatctgaatggttcattaatattcagaaacacctgtaaagtgactgaaaccactaagaacgttgtgttagcggatattaccgaagctaagctggcgggcaaagcacaaggtgctttacccgaagggtatgcgcctaaagaaacaaaggtgtcaatgaagtgttctggcaatatcaataattcttttcctgatggggcgggtattgtgcaggcgacaatgatgggggcagggtacagttttgacgctgacctcgcatcgaagggcattttgctggcgaagggggtggggaccatcattaacgacctgggcgttaaaattactcaggatgccgcaggccagtctctggtgaaactggatggtgtctcccccctgagggcgacaattaacaacgatatggctacggtgacattttattcttatcccacccctgcccggacaggggtcaatccaacaggtgcaggaggctatgaagcatcggctacgatgacctttgagatgccttgatagcgcagtcagtcccggctccagccggggctgacgtttatgaagggatctgctccggattaatctaaaaaagacctgcaacggagcagaacctttagccccggtcagcccggtagcaggtcacatccacttcgactttgcaatccaccaccagatccgccacgcagcacacgcgggcgggcgggtgttcgccgaagaattcgcggaacactttgttaaatgactggaagtagcgggcatccgtcaggaaaaccttcacatgcaccacgtcggccagggtgtaaccggcttcggtcatgatgtccacgcagttctggatcgccagacgggactgctcaatgatgccgccttccaccacttcgccgtctttcatcggcgtctggccggaaacatacagccagcccgccgcttccaccgctttggcaaacggcaaatgctgcccgcccgtgccggtgctgccaccgacgccataacgtctaatactcatttttgctccttatttggtttttcccggcgcagaaaacgccctgcgcggccagtgacctgctggtcctgaccataactcattaccccattcaccatcaccgcttcaataccggcggcgggctgtttgggatcgctgaaactggccacatcccgcacggtggccggatcgaacaataccagatccgcataatagccgcgtttgaccagcccacgttcgggcagccggaaacgggccgccgacaggccggtcatcttgtgcaccgccacggtgagcgggaacagcttttcgtcgcggctgtaatggccgagcacgcgggggaaggcgccccataaacgcggatgcggcatcggatcgttcggcagaccgtcagagcctatcatggtcaccggatagcgcagcacgcggcgcacatcctgctcgtccatgttgtagtaaatggccccggcaggcatcagtaatttgcccgcgtcatgcagcgacatcgaccagctttcggcgatctgcttaagcgactgcccggccacctccggatgcggttcagaccaggtgatgatgatgtcgaactcgtcggtgatctgcttcatgtccagcgtggacgaggaggcggagtaggggtagcagtcacaggcaacctcctgctgctggcgcacggtgtcgaacagcttcagcgtctccacagtgcgcccccagttttttgccccggcgcatttatggtgcgacaccaccaccggcaccctgccgtggcgaccgatacgaaacgcctcgtccagcgcctccagaatgggttcaaattccgaacgcagatgagtggtatagatgccgttttccgccgccagctcctccgccagcgccatcacttcttcagtggtggactggaaggcgctggcgtaggccagcccggtgctgaggcccagcgcgccctgcgacagcgcctctttgagctgcgcgcgcataccggcgatttcctccgccgtggccgcgcggaacagatcgtccatatgattgttgcgcagggcggtgtggccgatcagcgtgccgacgttaatcgccgggcgcgcctgcgcaatcgcctgcgcgtaggcgtccaccgtcgggaagacaaactgctgcgcctcgccgagcaggttcattggatcgggtacttcgccgtgcatggtcgcgcaggcggcgctgatcccgcagttgccgacgatcaccgtggtcacgccctggctgattttcggtaaataagcaggcatgcggataacattgatgtcgtcatgggtgtggacatcgataaatcccggcgccagtacgcgctcgctgccgtcgatttcccgcacggcgtggccttcgatagccggcgcaatctctgcgatgcgatcgcctttgatcgccacatccgcccggtactctgcgccgcctgatccatcgataaccgtgacattcctgaacagatagtcgaacttcatgtgatcctcaccccccttttggtctgcgctgaagttaaccatttacaagggataaaaacagtggaaaatgacacaaaacgcatatgaatttatgatacttttattcactatcggtggttttaaattaatacttgtttaaattacagtaagttataaaagatacccgatctgaaagatactgattcccctgaggagcgttgttatgaaataccagaatgaacacctcgtaccccataaagccgccctgatgtttaccccggccaacgtcctgaatgaggatgtctgcctgcccgcagcgctgatcaaaaaaaccgccctggagaacaatattcagtggatgcaggattacgccgacgcgcgcggcgtttctcttgcgcctcacggtaaaaccaccatgacgccgtggatctttcagcggcaacaacaggcgggcgcctgggcgattggcgtcggcagtgcgtggcaggccagcatcgccatggcgagcggcatcaggcgcgtgctgatggtgaatcaactggtggggaaggcgaacatgacgctgatctcacagttgaagaacacctatccggatgtggactatctgtgttgtgtggacagcgcggccaatgcgcaggtgctttccgcgtttttcagcgcgcagcagcagacgctggacgtactgattgagctgggcgtgccggggggccgctgcggctgccgtaccgcggatgaagcgctggcgttggccgctacggtggcggatctgccggggctgcgcttgcgcgggctggagctgtatgaaggcgtggtgcacggcgataatccacagccgcaggtggaagctttcctgcgcgaggcggcggcgctggcctgccagctggagcgctatgtcgacggtgaattcctgctcaccggcgcgggctcggtgtggtacgacgtggtctgtaacgtctggctggcggcaaaaaaaccggcggactgccgcatcgccattcggcccggctgctatatcacccatgatggtggaatttatcacaaggcgcagcatgcgctgatggcgcgcgactgcgttgcctgcgatctgggcggcgatctgacctgtgcgatggagctggcggccatggtgcagtcggtaccggaagcagggcgggctatcgtcaacttcggcaagcgcgacagcgcctttgacgccggactgccgcagccgatcgcccattaccggcagggtaaagcgctggctgatccttcagcattgatcgaaaccaccggcataatggatcagcacgccatgctgacactccggcccggcgcagaggtgcaggtgggggatattctgctgttcagtacctcgcacccgtgcctgacgttcgataaatggaaaacgctgctgctggtggacgatgagtacaacgtgctggaagaactggataccgaattctgacaggcgttccctctcccgtccgggagaggggaaatgcgcttagctgctggcctgcgccgcttctctggctttttcttccgcctgttgatggcgctcggtttccagcatctttttctcgtacaccttaaagaacgggtagtagatggcaagggagataaagaagcagacaaacaccagtccgcaggcgattaaattccagttcgtggtgatcagcgccccgagcggggccggaacggtaaagggcggtttaaccatcatgcgcgggatcaggccgctgatggtgcagagatagaccaccagcgtgtttgccatcggcgccaggataaagggaatggccagcagagggttcatcacaatgggcgcgccaaaaatcatcggttcattgatattaaacaagccgggaatgaaggaaatttttcccagctgtttcaggtaaattacccgcgagcggataaataacaccaccagcgccagcgtcgaaccggtgccgcccatctgcgcataccactggaagaactgctcggtgaaaatattcggcaggtcataagcactgacgccggactggaacagctccatattctgcacaatggcctgatcccacagcgggcggatcagcggccccatcaccgcatgaccatgaatacccagcacccagaacaggtcgatcataaactgcgtgacgatgccgccaaacagattcgtgccggtcataaagcctttcagcggcataatgagatagctgatgatggcgttaatatcgatattaaaaaagtgccgtgggatccagaataccagcaccacggcaagcgtcgggaatagtgcagagaatgaactcgccaccaccggcggcaccccggcgggcattttgatttcgatattgcgcactttaataaaacggtaaatctcaatggcgatcagcgatgagataatcgccccgaacagcccctgagagctgagcgaacttaatggaatataccgtccggtaaccgcatccccggcgacggtgaccccctgtttaatattgaccggcacgatcatcaggatggtcgccagcatcgccagcagaccgctggtaatatcgttgagcttataactttttcccaggaaagagccgatggtaaaggcggcatagagcgacatcagcccgacggtaaaacgaaacggaacatccagcatatcgcgccagggcgcgacaaaatccatatagcccttgatggggatattcagcaaaatcacaaagaatgagccgacaatggtcagcggcagaatggaaataagcccgttgcggatcgcctgcatatgccgctgattaccaatggcgttcgccagcggtaataacttttctgccagagtatcaaaagccgacatggtcactctcctcaaagccattattttcaattaccgtgcggaaccagcggcctgactttttcagcgagcgctgcccgctggctaaatccagacgataaaagccgtagcggtttttataggcattctgccaggaccagcagtcgataaaggtccacatgtgatagccgagacactggcttccgtcggcaatggccttatgcagccaggtaagatgttcctcaagaaaggcaatgcggtaatcgtcctgcacttcgccattcaccataaactgctcttcgtccatgatgccgattccattttccgagacgaaccacggaatattgccgtagcgatcctttatcagcattgcgatgtcatacagcgcgggaggatagatttcgatgccgcgggaagtattcatccggcggcctggcatgatgtattcctcaaagaagcgttcagggacaaaatcctgcgcttcggcaaggggcgtttcgcgggcttttacccgacgcgggcgataataattaattcccagcagatcgatacgcgtcgccgcaattaattcgctatcgcccggtaaagccacggggagctgattgtgttcgttgaggatggcgagcaattccggcggatagcggcccagtaatatcggctcgttaatactgcgggtataaaacagatccgccatcaccgccgcctgccgatcgtccgggctgtcgctgcggggatacaccggaatgacatccataataatgccaatttttcccggcagatttcttttacgccaggccgccaccgctttgcagtgggcaataacgatatggtgcagcacctgggctgcgcgacgaaaatcgctgacgtaaggataatggcggggatgaagataacccgcttctgccggaataaggggctcattaaaagtaaaccagtagcgcacccgatcgccaaacagctgatagcagatgtcggcgtaacgggcgaaggcctccactacatcacgattttcaaaaccgcctttttcctgcaatgccattggcatatcgaagtgataaagattaataaagggctcaatgccctggtcaatgagttcattaataacctggttatagaactcaaccgcgaggggattaatgtcgccatccccgtcaggtattaatcgtgaccaggaaatagaggtgcgaaaggagttgaggccaatatctttcgcgcgctgaatatcgtcccgccagtgctgataaaacccggaggtatcgtcggcggtgacgccgttataaaaacgctcgttatagtaatgcgaggcataatcccagatattgtcgcctttgcggtcgccgggtaagcgcccttcggactgggtggcgctggtcgccgtgccccaccagaatttatcaggaaagcggtatttcatgggcgatccttattttaccagtgacagggcgtgatcgaggactttatccccctgcatcgatccatattgcatcatatcgatagcatccaccggcacgccgtgcgtggcggcggcagcccgtaaactctgcaactggaacttcacctgcggccccagcaaaatcacgtcggcttccgtgacgatctgttcaaagtccgaaacgggaaccgcggtaatttccacttctacgttacgactgctggcggactgtttcattttttccactaacatgctggtagacataccggcagcacagcataagaagatctttttcattgcttttccctcagtgaataaacgccagaatgcgcgacgcgcggtggaaggtattctgggtagtgaccaaaaaacccacaagtgaggggggacacaaatcaggagttatagtctgatactttttgggggattggtgggtgtttggggggatagccgtttaaaatcaggggggtaggggtgttacttatatgaacggtaaaactttatcgtctgaaaacaaaaaggagtcagatgattttcatctaactccttgtttaacctggtggcccctgctggacttgaaccagcgaccaagcgattatgagttcctgccggaacaaccgaaaatcaatgttttgcgttatttatcattgacatagattgccgttgtttgccagtaactgccttcttccgccatctttatcgccattttatcgccatttgattagtaacttgagtcgatgaatcggtagtatccgaaaccagatttaagatgcagctcagagagcaaagctgacaaatcagcaggttctgatacttctactgactctgtacactcgtttctgatatccttggattcaagccaatatatatagccaactctttcataatattcttccatatcaaaatcatttccgtactttgataaaaaagcctgaatatacagaaggatggttcttgttgctcgttgaatcaaaaaatataatgttttccagttatcacctgtaaaaccatactctgggttaagatttatagggattaccccatgtgcgatgtcatttcttatatttcgaataatattgagggcatagcaacggtgttctttagggtaacttaatttattattcacttttttgttataaagcgaggtgtatcgttcgaataaagtgcataagttttgattgtaatgttcgaaatgttttggtaaatgcttttcctcaattttatcaaataaaatcagagatttcatactgttgtctctgacagggttcttgaaggatgtatttagctcattagtaaagaaggttgatacaaacctatagacttcttctaaagcattgcaaacgaagaaaagtctagttaactctgtggtataggcactaaagtatttcctgtcagactctaatgcttcgtaatgcggacggcacattattgataatgaacttctatcatgcaaataaggatttatttctacattatcaagagttgaagatagagttaaccactgattcattgcaagaaagtttgatctatgatctccgtagaagcattccgtcaaaatagctaattcatgcaggtggctttttatttccgttaaggaatgacataaagagcaatttttatctttcatctaaagtccctgattcaaagagcttaaaggatttagttttactgcatcttcgagatggtcgggggcaaagtgcgcatatcgcattgtcatttttatgtcggtatgaccgagtacgcgctgcaagaccaaaatattaccaccattcatcataaagtggctggcgaaggtatggcgcaaaacatgggtaagttgtcctgccggtagttcgatgcctgttctttccagagcagaccggaacgcgccataacaatcactaaacaaccggccttttttatcatcaggtagagactcatagagctctttgctgattgggacggtgcggttttttctgcctttagtgttggtgtatgtgattttgtatttcgcgagttggctttttctcagactctcagcctcagaccaccgtgcgccagtggcgagacagattcttaccacggtttctaaatcagggtggtcatgccgtttacactcaccgagcagttgcgcaatctggtcgtgagttagccaggccatttccatttcttctgtgcggaatgggcgcatatttttcagtgggttttcacccttccattctccgagacggtttagctcattgaacaccgcccggaagtaggccagctcaagattaagtgtgcgaggcgatacctctttcactctgtttgaacgagcatactcaccttttaaccgtttttctcggtagcgggaaaacatctgcgcatcgaaatcgcgtgcgggtggttcgcccatacactcaaaagcatggtgcatggctaactggcgtttcaagccgtctttcagggtaatgccatgagcgctataccatgaatcaaccagctcttttaacgtgcgcctgtcttccttttcttcctgccacgggttttgaacggtgtattgctcaaacgccagagcctcgcccttagtagcgaatttctttctgatacgtttgccttttgcgccgtttgggtagagttcacaaatccaaccgccagccggatttttacggacggtcatcagttaacctcgctgtatacacccaccacacgccccaacgctttaatatcatcaatgccgcattcgaaaggaaccttcccgcctgcaacatgtagttttctgcccggtagttttgttaactctcgaatgcttattgctccctcaatgtcgactagccataggccgtcagacaatgacgcttgcttgtccacaaaataaattttcccctcggaacggatagccatcccatctgtgagtggttttgtgaaaaattgggcatcaatgctcagttgcttatcggatttgaggatttcttcacttaatgtgaacccctcaatccttttagcgtcgctagattctctgttatttacaaacgcttccccttctccggtaagtaaccaccgaagattagcacctgtttcaagggcgcagtgagccgcaaagtcataggagatagcgcctcgggtgtacctatttgacaatgaactggatgcgatatcgaagtggttagctaattgaattttctgtgaaaatccatacgcctcgcagatgcggtcaagtacatctacgttgctccatcctaaagaatctattctcatttcgataaaacctatttactatctctcaattgggagatatattttggctaaacccacgcaattgatggcaagtgttggcaaacagagtcaaatcaattgcaaactttggctaatagggaatcatgcaatatggcttctgaaatcgcaatcatcaaagtgcctgcacctatcgttactctgcagcaattcgcagagcttgagggtgtatctgaacgtaccgcttaccgctggacaaccggcgacaacccttgtgtaccaatcgaaccccgcaccatccgtaaaggctgcaagaaagcaggtggcccgattcgcatttattacgcacgctggaaagaagagcagttgcgtaaagcgttgggtcattcccgttttcaactcgtcatcggcgcttaattcactttatgtgaattttaaggatgcaacatgtttgattttcaggtttccaaacatccccactatgacgaagcgtgccgggcttttgcgcagcgtcacaacatggcgaagctggccgagcgtgcgggtatgaacgttcaaacgttacgtaacaagctaaacccggaacagccgcaccagttcacgccgcctgaattgtggctactgactgacctgaccgaagactcaactctcgttgatggctttctggctcagattcattgcctgccatgtgtgccggttaatgaactggctaaagacaaattgcaggcctatgtcatgcgcgcaatgcgtgagctcggcgaactggcgagcggcgcggtatctgatgaacgtctgacctctgcccgtaagcacaacatgattgaaagcgttaatgctggcattcgcatgttgtcattgtcggcactggcgctgcatgcgcgtctgcagactaatcccgctatgacaagcgtggtcgataccatgagcggtattggcgcgtcattcggtctgatttgaggtgcttatgctgaaaagtgaaccgtcattcgcgtcgctgctagtaaagcaaagtcacggcatgcactacggtcacggctggatcgcaggtaaggacggcaagcgctggcacccgagccgctcacaggctgatttactggctggcctctccactcaaaagcagggggaatcatggctatcgaagctgtttccgcgactgttccgctgaaagcgggtgaacgtctggccggtctcaatcatgtagctgaattgcgcgcgagatattggggcgatagctggaaagaggtcgagcgttttgtcgatgatatgcgcgataaacgcgatccacaatttgaagaaaataatcgggcgctggccgctattttctttctggcaaaaataccggcggctcgtcatgagctcgaattaagtgagctgactactgacgagaaaaaagcgcttattacagcgatgaatcattttcgtgcagtagtgagcttatttccaaaacggctaaccatgccgaattaatacaaacagaaatttaatggcgtaaacccgccgggcttcttattgcccgaaatcaggagagtcaattatgagtaataccgaaacccgtagttttaacactgatagtgatgcgctggccgtattgctgaccgatgccaaaaaagaagagcgcaaagaccgcgcgctcgctgtttccatccgccttgaggcgctggctatccatatcaccaaagagggtatgagcggcaccgaagccgctgaactgctgcgccgtgaagccacacgctttgagaacgaatcacaggagctgcactaatggccgacgcaatggatttagcacaactgcgcgagcaggaagaccgagaacgccatatcagcaacgcgcgcagccgtatcgctgcaccttcccgttttctttgcgaggaatgtgacgcaccaatcccggaagctcgccgcattgcgattccgggtgtggccttttgcgtgacctgccagcaaatcgccgaactcaaatcaaaacactataggggcgtgtaaatgagcattcgaatcgaaataggtgataaatggattattaccagcgaccaatatcaattcatcctgaatgaaaagaaagtcgttaagtcaggtaaaaaagctggcgaggaatggcttgatactatcggctattacccaaagattaaccaacttatttccggtctggttcatcaccatattcaaaatgcaacgattaattctattagtgaaatggctgcggaaatagagagagttggcgctatctgctctgcggaatttaagggggaaaaatgagccagtcagctactgtaatttctgtttctgatatttcggagaaggtcagggaaatcgaaatagcataccaccgctatttgaatttattccgtatacccgatgaccataaaatagtcgtgaattattctgccggtaaagacagcactgcgactcttgctgtcgctaatgcactgttcggaaaccgtgtacaagctgtaatggcggacactgataacgagcatgagttgactgttgaatttgctcgcaacgtccatcagcaaattggctgcaacccagtgcaggtagttaagcgggtttacacagaggctgactttgctaaacgccgtgcatatatggagaaaaactggcgaaagcgtcaggcaatccgtatgggagtgtatcgtggaattgtgatgccgtcccttgctcgcgcggacactaaattcggtcaggcgtggttacgtaccgctgaacggtggggaattgaatttgaaacacctctcgacgcggcactttcagttttacatccatcaggaaacagcttcttggactgcgcattgcttcacggcaagtttccaatgctgcgcgaccgtttctgcactgatgaactgaaaattcaaatcgcttatgaaaaagcaatgctgccaatgctggacgatggtgatgttgttgttcaatggtctggtgtgcgagccgatgagtcatcaaagcgagctggttatgagcgtttcgctcccgaccgacgagacccagaatttttatataactttctacctatccatcagtggacagcagccgatgtttttgcgctgcataaatattttggtattaagccaaacccactatacatgcagggagcttcgcgtgttggctgcatgaactgtgttcttagcaataaagaagaaattgccgagacagcggcgcgctggccagaacacatcgagaagcacaagcaatgggaactaaaagttcgcctgaccagccgctgggtacactggatgagtgttggagaagttagccagcgctggatgaagcagtttgatttacctcttggcctcaatgttcagatgttaggtattacaccagaagtccagaacatcgattggtcgggattctatggcccgcgcggggggcttaattcacctagcgttggcgatgttgttgaatgggctaaaactggccgcggcggaaaggtttatgacctcgttaaagccagtcttgatacggctacttgctcctcgcgctacggcctgtgcgaatgagctccatttcttatgcctacccgtggaacactccacggtcggcaatagccagcccatatattacctatgagcaacagtatcgccgcgaccgtatgttcgcggctttgctgcatgcgagaaaggtgctttctctccagcccgagtgcgtgcgttttgacgtttatcgcaccgctgctgtgctggagcaaaatcatggcagtcaacgagccaatgcctttttaatcagcttctgcaaaaaggcattgccacgtctcgagctggtcgcaaaaaaatacgagtgtgcaggtatcaaaagcaacgtatcagtcgctgtttttggcggtcattttgataccgagcttatgcagtatctggcgtcacgcatggtcaatatggttgccagatataaccgcctccctgatatgtcgcgcgccgatatcgaccttttggccgctgatatcgcaaatttcattcgtgctgaactggccgacattgatgacaccggatttagcgagctcaaaacgctgtacacctggtacatgcgagccggtttcatttccctgcaattcaatgttaccccgccgcattgggagcgggtgacaaagaaatatgtcggtgaggatgaaatcgcccctgctatcacccgcatgtttaatgaggtttggtggcgtggccgcttgcgacgcattgcggctgcatggcgcgaacatctgcagatcgcagtcggcaatgtcagcaaaaaacgacacgcatatgcgagtaaaaactgcgtgaccgactggcgcgagcagaagcgccgcacgcgagaatttctcaaggggctggatctcgaagacgaagacggcaaccgcatcagcctgattgaaaaatatgatggctcggtcgccaaccctgcggtacgtcgctgcgagctgatgacccgcatccgtgggtttgaaaatatctgcaatgacctcggatacgttggggagttttacaccctgactgctccgtctaaatatcacgccacgactaaagcgggataccgtaacagcaaatggaacggagccagcccatcggatacgcaaagttatctaaccggcctttgggcgcgcattcgcgccaagctacaccgggaagaaatccgcatcttcggcatacgtgttgccgagcctcatcacgacggaacgccgcattggcacatgcttatgttcatgttgccggaagacgtcgagcgcgtgcgcctcatcatccgtgattatgcgtgggaggaagacctctacgaactgagaagcgataaagctaaaaaagcgcgctttcatgccgaggccattgacccggaaaaggggagtgctaccggctatgttgctaaatacatttccaaaaacatcgacggctatgctcttgatggtgaaaccgatgacgaaagcggcgagctgctgaaagagacagcccctgccgtttcggcatgggcggcacgctggcacattcgtcagtttcagtttatcggcggtgcgccagtgacggtctatcgtgaattgcgccgcctcgctgacaccgagaccgcacatggtctgagcgttgagtttgctgccgtccatgatgccgccgacgctggtgactgggctggttacgttaatgcgcagggtgggccgtttgtccgtcgtgctgatttgcaggtgcgcacactgtatgaaccgcgcgccgagtttaatcagtatggcgaggaaaccgtctgcatccgtggtgtctacgactctattgtcggcgctggcaccccgattttaacccggctaacgcagtggaaaattgtgccgaagcgtgccgttgatttggccgttgacgttaagggcgctcctgcgccctctcggagttctgtcaataactgtacggcaagcgaaagcgatccaccgttactggatttaacaaaaccgctgagtcggcgtgaaagacgagagctgacgaaccgactaaggaagcaaaggccagcaatacggcgaagattcttccacggcacggatgagcagaacgcagctataaagaaaactatcgatgagatacatctgacaaccggcattaatatcagtcggggcgaagccctgcacctgatggccggtggtaaaagttgtcttgatggcaaatggctacgcggaacgggtaaaggagagattttttccgcagcaccatcccatcaggctaaagctaggaaagttctcgatcgtgtagcggctttagcggaaatggcaacgaaagagtaagcggcaatgttcatccatatcatgtacatacagtatattcctatgcgattttttcttcacaacatttgtcgatccgtggtactgtatgtttatacagtatctcgttgtggaggttgtgtggatagagagttgatagaacacgtcatgatcgaacgtgtcgaaatgattgcgcgtctgacggctgatggtagttgtcaggaaagagatcgtgaaattgcattgaatttaattgcggagatagcaagagggaacttgatgaaaaataataatttctctgtagttttcgcagagccgcctgttgataagccttttgcaagggagggcaaagtgaaagttaatatcactttagataaagaccaacaaatcggccagctgattttagatgcttttcagcgtgagtaatccatgcggatacaatctgtttttccgtcaacacgtgttacggtaaaaaagggatccataaccggtattgagctgatgggtttcgatacagattctgaccgcgcagcagttgatagtattcttcaggaggtatgggaagatgagagttagcggtgatcttgtaagaattaagcaataatagaaaaagattaatatttattttaaaatgagtcgagtgaataactcattcgatttatttgcagaggacaagcgattgtttatttatatttcaatcttttcttttttagctaaatgtaatctaattaaaagctaatatatttgatttaatgtgattgttgtgtttcttcctctcctgtggcataatcgcgcgtatacatcgaaggagcgtatgaaaaaaatatgagaataaaatcactggaaacatacaattctcacagcaagttgagaataaatagaattgaattcgactcgttgactttaatggttggcgcatccggtgtaggtaaaacccagatacttcgatcaattaataaaataaagtctattgcgaacggcgattcagttagtggttttgaatggattgttgaattcaatgctgaaggaaacgactattattggtcaggtgaatttgaagcattaactgattatgatgaatttacttatggcatgtttaattttgatgatgatgataaaattgaaccaaagattcgagccgaagaagtaaaaattaacggggtggttgtagtatctagaaatggcgatgatatagtttataaagacagtaaaacagttaagctagcttcaacagttagtatagttcatcaccttcgcgaagaagatgatatttcagccatacataattctttttctcgagttgttgaagtagatgcagatgaattgcaacgtgtcttccctagaaaaaataaagacatgtctgagagtgaagatttgacgattactgaaatcagggagaagtcgttttcattaagcgcgaaactttatttgtgtcaggaaaagcaacctgaatactttcaacaaataaaaaattcatttgttgagatttttccatatattgaagatgttaaagttgttaaggttgacaccagcagttttccgttctttgtgcactcagtctatgctctcaaagtaaaagagcgtggtattgaagaatggatttctcataactcaatgtccactggtatgcttaaaacattagttcaattagcttatctgcatttaagccctactggaaccgtattcttaattgacgagtttgagaatggttttggtgttaattgtattaatgatattactgatgttttaattcatcatggtaatgatgtgcaatttattctgactagccatcacccttatataatcaacaacatccctttgggtaattggaagatcgtatcaagaaaagctggtgtagtggataactactcggcggatcattttaatttacaagaatctaatcacgaagcattcactaagttaattaatttaagtgtttattttgatggtgctgatagatgaatttatatattttagccgaaggcaaacaaactgaaagacgtctatatccagcatggatggacgtcttgtctccgtctgtaactaaggtggattatttgtcggccattgataataataactattattttatcagtggtgagggttaccctcggatgctagatgtgaccttggttaatgctctaaaggatcttactgaaaataaaaagataaccgatttttgggttgcattagattctgaaggcgaagatgttgagtctagagtgaagttggtgatggaaaaaatagctacttctggcatggatatctctcattgtaacgttcatgttattgtgcaaaacccttgcatagaaacttggggcttaggtaataaagttataatttcacccaataaactcaatccaacattcttgggcttccttaatcattatgatgttcaatcgaatgatcctgaggaaatgcagaaaccatctttctatgaagggtctattgcgaagtaccatgagagctatctaaaaagtatgttggcgttaaggaatgccacatatactaagaaaaaccctgctgcactaatggaaccctcgtatcttcaacagcttatcaacagagcttatgaagatgaggggcatatacagagctttaggctttttcatacgttagctacgcagctcgaagcccgggcacaagccatgaatgctgtaggtgcgtgaaaatttatgtattcggtttatcagcatatttgtgaatgatgaattgcatttagttgcatcattttgcattagttgcttaatgccaccctaatgggtctcatagcagatggcatatgactttattgctaaggggcaattgcattaaaaccgacccatcaagcgggcaggcgtggcggggaaagcattgcgcgccagcggtggtgcgtatattaaaaaatactgtctgagtgcgtcatgatgggcttaacgagatcgtttctggttcgtgggtggttctgtgcgaacgtggggctatggcttgtctgtggagcgatgcgagagggtgagatcagtagcacaattctacggttgcgcttccgttaatatcctcatcggcatgtcatgttccccaccaacagctggaggctttaatggataactatcacattacaaaagatggcgataagtggaagtttcaaaaggaaggaaacgagcggcctagcaagacggcatctactaaggctgaaatcatgcaggaaatgcaggattacatgtctgataagactggctcagtgaaaattcatacagaagacgggaaaattcaagaggagcggacttatcctcgcaaggccgatcctaaaaaaactaaaggctaattatattgaagccgccatcatggcggcttgagaaaaattattccgggttgtctagagtgtactctttgaacctgatgacctccatgccgagccactcgtttacctccctgaacctgtcctgcaggggcgacagctcgttacgaacgaatacctttgccaccttctcaacgtcgccggttgagccgatattctcgggcttgccgcccatgagctggaacggtacgcggtgcgcgtccatcaggtcggcggcactggccttcttgatgttgaaaaaatcatcctttgtggcgacctcgctcagtggaacgattttgatgccgtccggttttccgccgggggcgtagaaaaacaggttcttaaagttgccgagccccttcgagttgcgcatcgcctcgcgcagcgattcaacgtcggtcgcgctctgcgccgggtcggttacgtacatgatgtaccccgcatgcgcaccgttctggtaatacttgcggcggaacagcgttgcggcttcattcagccaggcggaattaagcgcgctgagatattccggcagaccgtaaatttcctgattaatgtcaggctccagcagatgaaacacagtatcaggcgcgaactcatgcggcagcgtgaagttttccacaaaccagaaaatcgaatcatcgaccccacgtcgggtgtacttggccggtgaggccagtagcttgattagctggccggtgacgctgtggcgcttctcaagaaaggcgttgccaaagaccagatagtcgagcgcaaagcggctgaaatcctgacgggataataacgggtgcggaatgtaggtgctcgcgagcacgttgcgcttaacgtaaatcggtgagctgtgatgcacggcagagcgcaggcttttcgccaggccggaaaaactgaccggcggctcgtaccatttgccgttactgatgcactcgacataatccagaatatcgcgtttatcgagcaccggcacaggctcaccgaaggtgaatgcctccattttttgcggggcgctggcggtcagttgctgtggtgcgcgggctttctgtgcggcggctttgcgggatttttgcttacccatcagttgaactccagaatagatttaggctgcatgccgctaccggcggaaagcggttcgtttaacagggcgtgcatggtcgcccatgcgatatcggcgtgactggcttcctcggtgcggctggcctcataagtggcgctgcgcccactgctggtcatggttttgcgaatcgacatgaaagactgtgttacgtcggtagccccggcgtcgtactccagacagccacggcgaatagtgtcttttgccttgagcaccatcgcggttttcatctcaggcgtgtaacggatgcctcgtgccgccgggtagaatgagcgcaccaactggaacacgccgaggccgaggccggtcgcgtcaatgccgatgtattcgacgttatatttttctgtcagcttgcggatcccttctgcctgagcggcaaaatccatgcccttccactggtggcgctccagcatgcggaacttgccacccgagaccaccggcggcgcgagcacgacgcatccggcgctgtcgccggtgtgcgacgggtcgtagccaatccagaccgggcgcatgccaaacggatggtcggcgaagggggcaaaatcatcccattgctccatcacatcaaccatgcagcgctgcagctcctcgaacgggaataccgacgctttatcgtcgacaaactcgcacataaacaggttcttaaagtcctcatcactgttttcgcgtttgagctggtcgaggtcaaacagggtgcagccaccggcaagcgcatcctcaatggtgacaatctgccgccactggccatcgtcgcagagctggccaccggcgagcgcactgtggctgatgtcgatttcgatgcggtcggcgatacggctgcgccccttattgaacaactcgccagaccagaaggggtaagcaccgtgcgccagtgtggagggtgttgaaaagtaggttgagcgcaggtgcttctgcgaggccatgcccgacgcgactttgcgcagcttctgaaaattcgggatccagaatatttcatcgacatacaggtcgccgttatggctctgcgcggtgttcgaattggtaccgagaaaaatcagctttgcgccgttattgccgatgacaatcgggtctccggaaaggtcgacgtcaaccagtcgcgcaaactgaatgatgtattcccggaacacgtaagcctgcgttttactggccgacagaaagatttggttatggccggtcttgagcgcgcgcagcaacgcctcgcgggagaaatagaacgtcgcgccaatctggcgagatttgagaatgtcgcgaatacggtgctccagccccgcgcggtaccactgcaactggtattcgaaagactggtcgaagaataattcttccagtctctcgatagcctcgtcactgaaaaaattctttttcggttttttgcgctcacccttgttgcggttggcgacgttggggtttaggtcggcctcgttgccggtctggctgtagcgattaacgcgcgccagtcgttcaatctggcgaccgagcaggtcaatctctttgaagtcgccgcctgacttttgcggcttggcgatgagctgaatcaggcgtgcctcaaggctgctttcgacgcgggaaatcggtgcaatgccgtcccagccgtcgcgctgcttccagctctgcacggtcgggcgcttgacctgcagcatttcggcaatctgtggtacggaaaaaccctgccagtaaagcagtgatgcctgccgtcgcgggtcatgcaacaaggttgtatcggtggaaatggtcattgatgcctcgccgttgtggattcagggcaaggctacttaatggtcgtcagtgattcgctaaggtgctgttgtgcaggcggttatccagtcgccattggtggtctggtgtggtctgagtctggaaactggcggtgaccagtaaccacaacctcaggattcctgacaatggcaaaaaaagtctcaaatttctttcgcatcggcgtcgagggtgatacctgcgacgggcgcattatcagcgccagtgatattcaggaaatggccgaaacctacgacccgcgtgtctatggttgccgtatcaacctcgaacatcttcgcggcatcctgcctgatggcttattcaagcgttatggcgatgtgaccgaactgaaagccgagaagattgacgacgattctgcgcttaacggcaaatgggcgttattcgccaaaatcaccccgaccgatgacctgattgcgatgaataaagccgcgcagaaggtctacacctctatggaaattcagccgaattttgccaataccggcaaatgctacctcgtcggccttgcggttaccgatgacccggcgagcctcggcactgaatacctcgaattctgccgtaacgcgaagcacaacccgctgcagcgcttcaaggccaatcctgaaaacgtcttttccgctgccacgctggccgaactggaatttgaagccgttcccgacacggtgttcaacagcttggccgataaggtgaaagccattttcagccgtaagcaggtcagcgacgatgcacgcctgaatgatgtgcatgaagcggtgaccaccgtcagtgagcatgtgcagacaaacctcaccaaacaggatgagcgcctttccgctatggaaaccgcgtttgccaccttcaggcaggaactgaccggcaagattgaagaaaccagccaggcattttcaaccctgaaaaccacccttgataaaaccgaaagtttcagccagccgcgacgcacgaaagccagcggcggtggtggcgacgagctgctgaccgactgctgataaaacgcagaccaaaaccgggcggtaaccccgcccgatgctgtgactaaccgattaattcaaacaggaaatactatgcgtcaggaaacccgttttaagttcaatgcttatctgacccagctcgccaaactgaacggcatcagcgttgatgacgtcagcaaaaaattcaccgtcgagccgtctgtcacgcaaacgctgatgaacaccgtgcaggcgtcgtccgcatttctgcagatgattaacatttttccggttgatgagctgaagggtgaaaaaatcggtgtgggtgtagatggcactattgccagcacgaccgacacctcaggcgacgatgagcgtgaaactgctgactttgtcgcgcttgagtccaatttgtacgagtgcaatcaggtcaactttgacttccacctgcgctacaaaacgctcgacttgtgggcgcgttttcaggactttcagcgccgcatccgtgacgcgattatccagcgtcaggcgcttgatttcatcatggccggttttaacggtactcatcgagcgccgacctcgaatcggaaaactaacccattgctgcaggatgtagcggtcggctggctgcagaagtaccgtaacgaagccccggcgcgtgtgatgagtaaaatcaccgacgctgacggcaaggtcgtttccgatgtgattcgcgtcggtaaaaacggcgattatgagaacctcgacgcgctggtaatggatgcgacaggcaccctgattgatgaggtttatcaggactcaactaaactggttgccatcgttggccgtaagctgctggccgataaatattttccgctggttaacaagcaacaggaaaacagcgagtcgctcgcggcggataccatcatcagccagaaacgcatcggcaacctgcctgccgtgcgtgtgccgtacttcccggcgaatgcggttcttgtgaccacgctggaaaatctctcaatctatttcatggatgagagccatcgccgttcaatcatcgaaaaccctaaacgcgatcgcgtggaaaattacgagtcgatgaacatcgactatgtgatcgaagcgtatgccgccgggtgtctgctggaaaacatcaccctgggcgatttcactgcgccggaagctgaggcgcaagccgccgaagcaccggaaggcggagagtaagcccatgacgagccccgcacagcgtcacatgatgcgggtctcggcctctcaagccgcgcagcgggaacaagccccgctgcgccacgcatccgcctacgagcagatgctggtaaagctggccgaagaccgccgcatgttaaaaaacatccgttcaaacgagcgcaaagccgagaaaaagcgcgagctgctgccgttctatgcgccgtgggtcgccggtgtgctggctgatggccgtggtgcgcaggatgacattgtcatgaccgtcatgctgtggcgtctcgatgccggtgacattgctggcgcgctggaaatcgccccctacgcgctgaaatacggcctcacctctgaccatcgccgcaccacgccttacatgctggttgaggaggtggcacttgccgcgcagcgcctgcgcgataccggtgagcctgtcgacctcgcattactgctgaccaccctcagcctgactgacggtgctgacgttcccgatatggtgcgcgcccgtctgcacaaggtgaccggcctgacccttcgtgatgcaggtcagaacgccgacgcgctggcgcagtttcagcgcgcgatgcagctcgaccgtaacgccggtgtgcgcaaagaaattgagcggctggaacgggcattaaagccgaaagcggaagcgctaccccgtaaaacgactaaaccgcgcacgcgcaaaactgccaccaaaccggcagcgaagcgcggacgcccaccaaaggcggtaaaaaccgccggttaactgaacgctccccgagccgggcggcacgccggtcaaagcgggtattaaccctgacggcgaccggcgtccaccgcccaacctaatgaggttgtcatgacgacagtaatactgaatcagcccgacgaaccgcagggcgtaccgggcgtggtgattcccgcaccggagacgggcgacgcagtgattaaaaacacgttcttttttcctgatgtggatccgaagcgcgtgcgtgagctgatgcgccttgagcagacggtttccgatgcgcgtctgcgtaacgccatcaagatcggcatggcggaaaccaatgcggagctttacgactaccggctgcaccagattgccgcaggctttaaagaactggccgacgtgcctggcgccgaggaaatcgacggcgagaatgtgcgaattttccactacctgagcgccgtgacggcgatggcgaccgccacgctgtatgagcgttatcgcggggttgaggccaccggcaagggcgataaaaaagccgacagcgtcgaaaccaccattgatgacctgtggcgggatatgcgctggtcggtcgcacgcctgcaggataagccgcgctgcatcgtgggtcagctctgatgaaagtctatgcgatgcagggcgacaccctcgacgcactttgcgcccgctattacgggcgcactgagggagtggtcgagaaggtgctgcaggctaatcccggcctgtctgagctgggcgtcattctgccgcatggcacggcgattgacctacccgacgttgaaacatcacccacggcggagaccctgaacctatgggactgagtatggaaaaaatcaccacgtttatcgcctactggctggccgtgggggtggcgtatttcggggcaatgtcgcccgaaaagctggcgctgtatgtgggtagtctgtgcgccatttttacggcggcggtgaatttctggtaccggcgcaaaacctttcgctatctgaccgaaatgggaatcgacaaaggggtgacccgtgagctcaatcgttaaacgttgcagtgtggccgcagtgctggcgctggcggcactgatgcctgattttcgtctgctgaatacctcgcctgatggtctggcactgattgccgacctcgaagggtgtcgcctgacaccttaccagtgcagcgcgggcgtgtggacatcaggcatcggccacactgccggggtggtaccgaaacgcgatatcaccgagcgcgaagcggcggcaaatctggtcgccgatgtactgaacaccgagcgccgtctcgcggtctgcgtgccggtcaccatgccgaaacaggtttacgacgcgctggtcagtttctcttttaacgtcggcacaggcgcggcctgtcgctcgacgctggtctcttacatcaagcgtcatcagtggtggcaggcatgcgaccagcttacccgctgggtgtacgtcaacgggcagcgtaataccggcctcgaaaatcgccgtcagcgtgagcgcgcttactgtctgccgggggtgaaatgaaagttgtagtcatgctgctggtactggccgtactcggcctgctgtggttgcgtcatgagaacggcaatttatcccgctcctttgagacggcaaaccgggtcgcgagcgcacaaaagacgacgattggcatgctgaaaaatcagctcaatgtcgcgggtacgctcgcccgacgtaatgaatccgcgcaggtggcactgcgtgaacagctcgcaaaggcaagcgcagaggccagccgccgtgagcagacgataacgaggttactcaatgaaaatgaagcctttcgccgctggtataacgctcctttgcctgatgttgtgcgtcgggtgcacttccgccccgcctgcgccagcgccggtgattgtggtcagtggatgcccgagggtgagcctttgcccgatgccggaaagtgatccgaaaactaatggtgacctgagcgcggatatccgccgccttgagggcgcgctgaccgcctgcgcgctgcaggtcaaaaccgtcaaacactgtcaggatgaactcgatgcagaagcacaaaagcctgcgcacagcactgattaacgccgtgccgcagctccgaaataaccccgagatgctgcgcctttttgctgacaacgggcataccgattcccgactggcgaactcgctgtcgtttgaaaaggtgtacgtgcttaacgtggtggttactgacttcaccggcgatcttgatttgatattcgtgccggtgcaggcatggctgcgcgaacatcagccggacattatgaccaccgacgacggtcgggaaaaaggattcacctggatgattgatgtcaataacgacgattcactcgatatcagtatcagcctgaggctcaccgagcgcacgctcgtcaaagaggtcgatggcgcgctgcatgtcagctatgccccggagccgccactgcctgagccggtgacgcgcccggtggagttgtacgttaatggcgaactggtgagtaagtgggatgagtgacttaaccgtcctgcaggaacgccttgcaggtctgattgccagtttgtcaccggcggcgcggcgacaaatggcggctgagattgcgaaaaagctgcgcgccagccaacaacagcgcattaagcgtcaacaggtacccgacggcaccccgtatgccgcgagaaagcgccagccggtgcggagtaaaaaaggccggattaagcgcgaaatgttcgcgaaactgcgcaccagtcgctttatgaaagccaaaggcagcgacaatgcggcggtggttgagtttaccggcaaggtgcagcgcatggcgcgggtacatcagtacggcctcaaagaccggccaaaccgcaacagccgggatgtgcagtacgaggaacgcccgttgctcggttttacacaagaggataatatattaattcaggacgcaatgatttccattttaggaaaagggtaatatctatgaatcagcctaatactttatataaatatgtaaggccggggtctttaaagttaattctagaaaatcaatcgttgagatttccaacccctaaggaatttaacgatccctttgattgtaatttccctagttacttgggttcgattaatatggaaaaaatatttattaagagctttcctagaagtatgggggaggacaagaaaaaactactagcacatattaaaagagaaaatgtattttcaggctttcacgaaatgatactttctaatattgaggatgttcgcaaaagttgggatgaatacatagaaaactacagagtattatgcttagctaaagaaaaagataacattctgatgtggtcgcattatgcggtcaaccactctggaacagttgtcggctttgatacctcggccgaaaaattcacatcggaagctcgtccggtgagctacccaaataaaaacaatactctagatgaacagatgaaagttcaccttgctgaagtgtttaaatacataatcaatcataaagatggaattgatgccgcctttagtgaaggtaatgcattcttaaatcatccgaataagtcactcctccttgcaaaatatgtcataaacaagttaagcccatttttctatgttaaaaaaacaatatgggaatatgaaaatgagtttagattcattaggcaaaaaaggaatcctgactcggaatggttgaaatttgacatctcctcagtaagtgatgtgacttttggcattaaaacctctgcatctgagaaggaacaagtcatagcattactcaaagaatataaagccacgccctcagtttatcaagctgtcaaaaaaaatgcagaaatggtgtttgcaccgatgaggttgtagttacataaacagcattttcataattaacacccgtgttgtgtgatagtcgatactattctgactctttgccgtttatggatatgagcggcattcttcacacactatgaatactttaaataatatccaagatctcgcgcgtgcgattcgcaacctcatccgttcaggtgtggtgactgaggtcgataccgtgcaggggctgtgccgcgtacaaagcggcgggatccaaacgacctggctgaactggctgaccacccgcgccggtcgttcgcgcacatggtgggctccctcggtcggtgagcaggtgctgctgctggctatcggtggcgagcttgataccgctttcgtgctgccgggtattttctcggacgataaccccgccccgtctgcctcggcggatgcgtggcatgtggttttccctgatggcgcggtcattgagtatgagcccagggatggcgcgctgacggtaagcggcattaaaaccgccgatgtgaccgcatcggaatccatcaccgcaaccgtgccgctgatactggtgaaagcctcgaccagtatcaccctcgacgcgccggaagtgatttgcaccaacaagctgacgacggcgacgcttgaggtgcagaagggcgggaccatgcgcggcaacattgaacataccggcgggaaactcacctctaacggcgtgcaggttgatgaccatgaccacggtaatgtccagagcggcgggaactggactaaggggatccaatgacggcacgttatcagggcatgaaccgaaataccggcatcggcatcagcgacactgagcacatcagccagagcatgcgcgacatactgctgacgccggtcggctcgcgggtgatgcggcgtgaatatggctcgctcctgtctgcgctgattgatatgccgcaaaaccctgcgctcaggctgcaaatcatggtggcgtgctattccgcgatccagaagtgggagccacgcatcagacttacatccatcagctttgagaccggcggcgctggcgagatgtatgtcgatattaccgggatgcgtaccgataccggtgcgtcagtttcaaccaccgtttcactgagttaaatcactatggcaactgttgacctgagtcagttacctgttcccgatgtggtagaggaactggattatgaaaccatccttgcggaacgtatcacgacgctgatttcgctttatccggaagaccagcaggaagccatcgcccgaacactgacccttgagtcagagccgattgttaagctgttgcaggagaacgcctaccgggaggttatctggcggcaacgggtgaacgaagcggcgaaggctgtgacgctcgcctattccaccggcaccgaccttgacgtcgtggccggaaacaacaataccgaacgcctgaccatcaccccggcggatgactccaccatcccgccgacacctgccgtcatggaatcagataccgacctgcgtctgcgcgcgcaacaggcgtttgaggggctgagcgtggcgggtccggtcggggcatatgaatatcacgggcgcagcgctgacgggcgtgtcgctgacgtctcggtcacaagcccgtcgccagcctgcgtgacgattaccgtgttatcccgcgagggcgacggcaccgccagcgaagagttactgacaatagttgataaggcgctgaatgccgaagatgttcgcccggtagctgaccgcgtgaccgtccagtcagcggagattgtgccctaccagattgatgcgacgctctacgtttacccaggccccgaatctgaacccatcagacaggcatccgagcagaaactgcagagttatatcagcgcgcagcaccgcctcgggcgtgatatccgcctgtcagctatttacgcagcgctgcatgttgaaggtgtgcaacgggtcgaactggcatcaccgcaggccgacatcgtgctgagtaaatcgcaggcgtcaaactgcaccgagtaccagattgctatcgggggatcggatgagtgaccggctgttacccgcaggctcatcaccccttgaggttgccgctgccgccgcgctcgcagagattaagcgtgtgccggtaccgcttcgcaccctgtggaactggcgcacctgcccggtaaacctgctgccgtatctggcgtgggcgctgtcggtcgacaggtgggatgaaaagtggccggaagcgacaaagcgcagcgtctgtgcgtcctcgttttatgtccatcagcacaaaggaaccatcagtgcactgcgtcgggtggttgagccgctcggctttctgattgaggtgcgcgagtggtggcagctcaacgaggcgccaggcacattccgtcttgttgtcggcgtgctcgacagcggcatcactgacgaaatgtatcaggagcttgagcgcctgattgatgacgcgaaaccggcaagtcgccatctgaccgggctggctatcagcctgagctcgaccggcgagctgtatgtcggcgcgggatgctacgacggcgacgcgctgaccgtttacccctacacccccgaggaaattgtcgtcggtggtgaatattacccggcctcggccattcatttgattgataacctgagagtgaacgcatgaccgcaaaatattttgccattctgaccaatcagggcgcggcgcggctggcgaacgcggcggcactcggtactaagctcaacctgacgcagatggccgtcggtgatgcgaatggtacgctgccgacccctgacccggcgcagacgaagctcattaaccagaggcgcatcaggccgctgaacctgctgaccgttgacccggacaataacagccagattatcgcggaacagattattccggagaatgagggcggtttctggatccgcgagattggcctttacgatgatgaggggattctgattgccgtggcaaactgcccggaaacctataagccgcagctccaggagggaagcggccgcacgcagaccattcgcatgattttgattgtgtcgggcacgtcggccattactttaaaaatcgacccgtcggtcgtgctggcgacgcgaaaatatgttgacgataaagctattgaggtttcgagttacgccaacgaaatcatgcgactgcataagcaggacagcaatcctcattcacagtatgcaccgattcaaagcccggaatttacgggtaaacctacagccccgacaccggcaaaaaattcgaatgacaggcaactggcaacaactcaatttgtcagcaccgccatcagtgaactggtaagcaacgcaccggcggcacttgatacgctcgcaaagctcgcggctgcgattggcaatgatgcgaatttttcgaactcactgtcggaaatcatcaagaacaaacagaattacgataagacattaagtgatttagccgggaaaacacctgctcaaattctgttatatcttggcctgccttcgcttattaccggtaatgtcaccgagtcgctgaatacgctggaaaaagtggcaaatgccattgataacgatgctaattttgcaaattcaataaaaaccatactcgggaataaacaaaataaggacgataccttaacaaatctgtccggaaaaacggcggcgcaggttgccgtatatataggcgcgcttcgccagtcacaaaatctggctgatctgcctaaccctgaaaccgccaggacaaatcttgaggtgcctcgcggtgtggatgctcagatgccctttgcctggtgtaagttcaacggcgcatcagggctgatttatcgtgcgcataatatttcaagcgtccggaaagacgctaccggacgctttgctttcaatttcacgcgcgcatccgtgacatcagattatgcggttattggtagcgccgtactgcccggcgcaccggttgaccagattgtccgtgtatttggtgcaacagacaggctgacaacagggtttaacgttgtcgcgatggataacaataccgacacgtatgctgatgcagtaatcgacgtgtgtgttttagggggctgatgatgcaggcaattattttcgaaaatcagggggctgccggggtgctttttccggcggcgtgcggattgtccgtccttgatattggtcgtaaggatgtgcctcagggggtcagcttctggattgtcaacgctgaggatttaccgggtgccgcgcttgaggcgtgggagctcaacatcaaaaaaatgggtgcaccggccggaacaggcgggacatatattgccgcagaaggagaaattgatgataacggtaaataaaaccagcctggctgcaattgatgctgaaaaaatccgggcgcgtcgtgatgcgctgctccgcgaaagtgactggtcgatgatgccggatgcgccaacggataaaaaagcatgggctgcttaccggcaggcattgcgcgacataccactacaagaaaaatacccgtcagtggtggcatggccggaactgcccggcgaagaataatcaggctatacaggcgggctgatgcccgtcttttttgatttgtttatgtgccattcgctatccatcgccgacaaatagcccctcaccagaccagccaggacaataacactcgcccactaaccacggagttaaccggatgagtgattttcaccacggcgtacaggtgcttgagattaacgacggcacccgcgtcatttccactgttgcgaccgcagtcgtcggcatggtctgtacggccagcgatgcggatgcagcaacattccccctcaatgagccggtgctgattgccaatgtgcagagcgccattgcgaaagccggtaaaaaaggcacgctggccgcatccctccaggccatcgccgaccagtcaaaacctgtcaccgttgtcgtgcgcgttgccgaaggtaccggagaagatgcggaagcgcagacaatttccaacatcatcggcggcacggatgagaacggtaaatataccggtatcaaggcgctgttgactgccgaagcggtcaccggcgttaagccgcgcattctcggcgtgccgggtctcgatacgcaggacgtcgcgaccgcacttgcatcggtctgtatcagcctgcgagcctttggctacgtcagcgcatggggctgcaagaccatttctgacgccatcaaataccgcgacaatttcagccagcgcgagctgatggttatctggcctgacttcctttcgtgggacaccaccgcgaacgccaccgcaacggcctacgccactgcgcgcgcactcggtctgcgtgcttacatcgaccagactgtcggctggcataaaaccctgtcgaacgtcggcgtgcagggtgtcaccggtatcagtgcctcagtgttctgggatttgcaggcatccggcaccgatgctgacctgctcaacgaggccggggtgacgacgctggtgcgtaaggatggtttccgcttctggggtaaccgcacctgttctgatgatccgcttttcctgtttgaaaactacacccgcaccgcgcaggtactggccgacgcaatggctgaggcgcacatgtgggcggtcgataagcccatcaccgcatcgctcatccgcgacattgtcgacggcattaacgccaaattccgcgagctgaaatcaaatggctacatcgtggacggtgaatgctggtttgacgaggaatcaaacgacaaggacaccctcaaggccgggaaactgtatatcgactacgactatacgccggtgccaccactggaaagcctgaccctgcgccagcgcatcaccgataaatatctggtgaatctggccgaatcggtcaacagctaaggagcctgaaacaacatggcactaccccgcaaactcaaatatctgaacatgttcaatgacggcctgagctacatgggtgttgttgaatccgtgacgctgccaaaactgacccgcaagctcgaaaactatcgcggcggtggcatgaatggcgcggccgcgattgacctcggcctcgacgacgatgcgttaaccgtcgaatggtctgttggcggtctgcctgatgtggcgctgtgggcgcagtatgccgcgccgggtgctgatgccgtgccgctgcgtttttctggctcttaccagcgcgacgacaccggcgaaatcgtggcggtcgaggtggtcatgcgtggccgtcataaggaaatcgatggcggagagaataagcagggtgaaaacacctcgaccaaactgtcgaccgtgtgcacctactaccgcctcacgattgatggcagcgacatcatcgaaatcgacaccgtcaacatggttgagaaggtgaacggcgtcgaccgcctggagcagcaccgccgcgcaatcgggctgtaattccctgaccggtcagcactgctggccggttattaatcccattcagagcagagaaaaacatcatggcaaaagcaccacgtaaaaccgctgaatttgttgatacgactggcaatgaagttgttaccgaaaaccagaacgtcgtgaccctcgacaagccgatccagcgtgccggtcagacgattgataaagtcaccctgattgagccgaacgccggtaccctgcgcggcgtcagtctggcggctgtggcgcagtccgaagtcgacgcgctgattaaagtgctgccccgcatgacctatcccgcgctcaccacgcaggagctgaccgcgatgaacctgcccgatatgctgtcgctggccgctaaggtgattggttttttgtcaccggcttcggtggaatagattttccgcccaacctgtcgaccgatgacctgatggcggatattgcagtgatattccactggccgccatcagagctatattccctgagcctgaccgagctcatcacatggcgcgaaaaggcgctgcagcgtagcggaaaccacaatgagtaataacctgaggcttgaggtattgctgaaagcggtcgaccaggcgacacgaccgcttaaatccatccagaccgcgagtaaaaccctgtcgggcgatattcgaaacacacaaaaagggctgcgtgacctgaacggccaggcgtcgaaaatcgacggctttcgtaaggcaagtgcgcaactggccgtaaccggtcaggcgcttgataaagctaaacgcgaggccggtgagctggccgtgcagcttaaaaacaccaccagtccgacccgcgcgcaggcgcaggcactcgacgcggcaaagcgtgccgcctctgagctgcagacgaaatacaacagcctgagaacgtcggtacagcgtcagcgctcggagctgatgcaggccggtattaatacccgcaccctgtctgccgatgagcgtcggctcaaaacctccatcagcgaaacgacagcgcagcttaaccgccagcgtgaagcactggcgcgcgtcagtgcgcagcaagctaagttaggccgggtgaaagagcgatataaatcaggcaaggagcttgccggtaacatggccgctgcaggtgctgccggggtcggtatcgcgacagcgggaacgatggcgggtgtgaagttacttacgccgggttatgactttgcgcagaaaaattccgagctgcaggccgtgctcggggtcgataagcaatcaccagaaatgcaggcgctacgcaaacaggcgcgccagctcggcgacaatactgccgcgtctgctgatgacgcagcgagcgcgcaaatcatcattgcgaaaagcggcggtgacgctgctgccattcaggcagcgacgccggtcacgctgaatatggcgctgtcaaaccggcgcacgatggaggaaaacgctgcgctgctgaccgggatgaaatcagcatttcagctttcaaacgacaatattgcgcacattggcgacgttctctcgatgaccatgaacaaaaccgccgcagattttgacggcctgagcgacgcgctgacctatgccgcgccggtagcaaaaaatgccggggtgagcatcgagcaaaccgccgcaatggtcggtgcgctgcacgacgccaaaatcaccggttcaatggcgggcacgggtagccgcgccattctcagccgcctgcaggctcccaccggacaagcgtttgaggccatcaaggagctcggcgtcaaaacgtccgacagcaaggggaacacgcgcccgatattctccatcctgaaagaaatgcagcgcagctttgagaaaaacaacctcgggacaagccagcgcggcgagtatatgaaaaccattttcggcgaggaggccagctcggcggcggcggtactgatggaagcagcctcaagcggcaaacttgaccggctcaccgcagcgtttaaagcctcggacggtaaaaccgaggaactggttaaggttatgcaggataacctcggcggcgactttaaagagttccagtctgcttatgaggcagtcggtaccgacctttttgaccagcaagaagggtcactgcgtaagctcactcaaaccgccacacaatacgttttaaagctcgacggctggatccagaaaaataaggggctcgcgacaactatcggcatcattgccggtggtgcactggctctgattggcatcatcggcggcattggcctcgttgcctggcctgttgtcatgggaatcaacgccattatcgccgccgctggcgtgatgggtacggtctttactgtcgccgggagtgccattgtgaccgcactcggcgcgattacctggccgattgtggccgtcggggcggcgattgtggccggggcactactcattcgcaaatattgggagcccatcagcgcatttttctcaggggtgattgagggcatcatgagtgcctttgcaccggtcgggcaaatgttcgctccactgacaccaatctttgacgggctcggtgagaagctgcgcggtgtctggcagtggtttaaggacctgattgcaccggtcaaggccacgcaggagacgctcgatagctgtaaaaatgtcggcgtcatttttggtcaggcactggactcagcgttgatggcaccgcttaacgtctttaacaagctgcgaagcggtgtcgactggcttctcgaaaagctcggcatcatcaacaaagagtcggacaatctcgaccagaccgccgcaaaaaccaacgccgccacgcagggtaattcctacatcccggcaaccagcacatatggcggctatcaggcttaccagccagttaccgcaccggcggggcgctcttacatcgaccagagcaaaagcgaatacaacatcactctgccgggtggcgttgcaccggggcatcagcttgaccgacagctacgtgacacgcttgaacagattgagcgtgataaacgtgcgcgccagcgtgccagtatgagtcacgactactgagagggatttaaacgatgatgcttgctcttggaatgtttgtgtttgagcgccgcaccctgccttatcagtcgatgcagcgctcaaaagattatcgctgggcgtctaatgaccgggtcggcaagccgcctgcatatcagtatctcggcgaaggggaaacttcactccagcttgccggtacgctttaccctgccattactggcggccgcatttccctgcaggccgttgagctgatggccgacgagggcagagcgtggcctctcattgagggaaccggcacaatcctcggaatgtttatcgtcgacaaggtatcgaccacgcacactgagtttttcagtgatggcgcggccaggaagattgattttacgctttcgctaaaacgggttgatgagtcactgacagcgatgtttggcgatctgaataaacaggccggggagcttctcggctctgtcggtaatctgaccgataaaatgcagggtatgctcggagggctgacactatgataacgggcatgaccatcgacgccggtgccagccttgcgccggcctttatgctgacaatgaacagtaaggacataaccagcaattttagtgaccggctgatttctctcaccatgaccgacaaccggggctttgaagctgaccagctcgacattgagctcgacgacaccgacggaaaagtcgagctgcccctgcgcggggcggtgctgacgctgtggcttggctggcagggctcggcgcttctgaataagggcgatttcacggtcgatgagattgaacaccggggcgcgcccgacaccctgaccattcgcgcacgtagcgcagactttcgcggaacgctcaattcacggcgtgaagaatcatggcacgataccaccctcggcgagctggtcagcaccatcgcaaagcgcaataaactgacggccagcgtagcggattcactgaaaaaaataccggtaccgcatatcgaccagtcgcaggagtccgacgccgtatttctgacccggctggctgaccgcaatggggcgacggtgtcagtgaaagcggggaagttgctgtttctgaaagccggtagtgcgatgacggccagcggcaaacccatcccacaaatgacgcttactcgcagcgatggcgaccgtcatcagtttgctattgccgaccgtggagcttataccggcgtaaccgcaaaatggttgcataccaaagaccctaagccgcaaaaacaaaaagtggcgctgaaacgtaagccaaaagaaaaacacctgcgcgcactggagcatccaaaagcaaagctggtcagcaaaaagccaaaggccaaaaaagagccggaagcgcgcgagggtgagtacatggccggtgaggccgataacgtgctggcgctgacgacggtctacgcttccaaggcgcaggcgatgcgagccgctcaggctaagtgggataagctgcagcgaggcgttgcagagttttcaattacgctcgcgcttggcagggctgatttattccctgagacaccggtgcgcgtatcgggctttaagcgcgtcatagacgagcaatcttggttaatcagtaaagtgacccataatctgagtaatagcggcttcacgacgggcttagagcttgaggttaaactctctgatgtggagtacagcgcggaatcggataacgaataaaattaattcacaaaaagtgaatcgatggttatcattgcttcacgaattgagaataagaggtggattatgtttcattgtccgaagtgccatcatgccgcacatgcgcgaacaagccgctatctaaccgaaaacacgaaagagcgctaccaccagtgccagaacatcaactgtagttgcacatttatgacaatggaaacgatagagcgctttattgttactccgggagccattgacccggcaccgccgcacccgactgtcggtggtcaacgaccattatggctctgataaatttccgctaaatgcccgccgcgtgcgggtttttttatgccctcagcaaagtggcggtaaaaaatccaccgccattctatcgccactcgaaaacgaggaaacaaaaaggccactcgcgaaagtggcctaaatatatgtatttacttataaaatctggtggcccctgctggacttgaaccagcgaccaagcgattatgagtcgcctgctctaaccactgagctaaggggccgtggcgggggattataatgtaacttcccgcttcaatccagccataagcgtgtgcctgccgtttttataaacaacctataatcaatcctttatactttatggatgatcccataactggagctttagatgatcaacgatattctcgcgcctggcctgcgggtggtgttctgcggcattaaccctggtaaatcgtcggcgcatacgggctttcattttgcgcatccgggcaaccgcttctggaaggtgatccatcaggcgggctttaccgacgagctgctgaagccggagaaggagatgcggctgctggatacccgctgcggcatcaccatgctggtggagcggcctacggtgcaggccagcgaagtagacctgcatgagttgcgtaccggcggccgtgagctgatcaagaagatagaagactatcagcctcatgcgctggcggtgctgggcaaaaaagcctatgagcaggcgttcagccagcgcggtgtgaactggggtaagcagaagatcactattggcgcgaccgaggtatgggtgttgccgaatccaagcggcctcaaccgggcgacgctggataagctggtggaagcgtaccgggaattagatgaagcgctgatcgtgcgcggtttatagcgcccataaaaaaccctccggagagggcttttcacaaacggcttgcgggcgattaatcgtccaggaagctgcgcagcacttcagaacggctcggatggcgcagtttacgcagcgccttcgcttcgatctgacggatacgctcacgggtaacgtcgaactgtttacccacttcttccagcgtgtggtcggtgttcatatcgataccgaaacgcatacgcagaactttcgcttcacgggcggtcaggccagccagtacgtcatgggtggcggcacgcaggctctcggtggtggcagaatccagcggcagctcgagggtggtatcctcgatgaaatcacccagatgcgaatcttcatcgtcgccgattggcgtttccatggagatcggctctttggcgattttcagcactttacggattttgtcttccggcatcagcatgcgctcggccagctcttccggcgtcggctcgcggcccatttcctgcagcatctggcgggagatacggttgagcttgttgatagtctcaatcatatgcaccggaatacggatggtgcgcgcctgatccgcgatggaacgggtgatcgcctgacggatccaccaggttgcgtaggtggagaacttgtaaccgcgacggtattcgaacttatcaaccgctttcatcaggccgatgttgccttcctgaatcagatcgaggaactgcagaccgcggttggtgtatttcttggcgatagaaataaccagacgtaagttcgcttccaccatctctttcttcgcacgacgcgctttcgcttcgccgatggacatacgacggttgatgtcttttacctgctcgatggtcaggccggtctcttcttcaatctgctgcagtttttgcaggccgcgctgcacgtcttctgcaacttcatgcagtttttcagaccacggcttgttcatcgcgatagccgcgttgagccaggtttcgctggtttcattgccggtgaaaagggtgatgaagtttttcttcggcattttgcactgttcaacgcacagcttcatgatcaggcgttcctgggtacgcacgcgatccatcatgacgcgcatgctgttaaccaggtagtcgaactgtttcggcaccaggcggaactgcttgaatacttcagacagcttcaggatctcttcctgagcgctggcgtgcgtgcggcctttggctttgatggtgtcgcgggtgaccatatactgcgtacgcagctcggcgaacttctcacgcgccagttctggatcgatgctgttatcgtcgtcgctgtcgtcttcttcttcatcttcgtcttcatcgtcgtccgccatctcttcggtggacaattcagaaccgacatgcgtcgcggtaggggccagatcttcttctgcgttcggatcaacaaagccggtgatcaggtcagacagacgcgcttcttccgcttccacgcgatcgtactgctccagcagataggtgatcgcttccgggtattcggcaacggaacactgaacctggttgatgccgtcttcaatgcgtttggcgatgtcgatttcgccttcgcgggttaacagctcaacggtacccatttcacgcatgtacatgcgcaccgggtcggtggtacgtccgatttcagactcaacgctggacagcacctgtgcggcagcctcttccgcatcttcatcggtgttgttcgagttttcagcaagcagcagatcatcggcgtccggtgcttcttccatcacctggatgcccatgtcattgatcatttggatgatgtcttcgatctgatcggagtcgacgatatcttccggcagatggtcattgacctcggcataggtcagatagccttgctccttaccacgttggacaagaagtttcagctgtgactgcgggttttgctccataagacggtatccacacttaattcatgagggttggtgtcggtcggcgaaactaagccgccaacataagctaatgagggcttacttatatttttgccgctgcccttcaatgcggctgtcggggtcttcccgaacgatactcggcacttaagccgttaaattcatttgcgggcgcgcgcttctgtaatgacgcgcacctcttcgcgctccgctggcgttaacccgtgggtccgcgagcgggcgatcaattctgagagccgaagctcaagtaccgagtcgaacatgtggttcagcgagtcggtgaacgttttttctgcaatgtccttatcagctatatcgtcccacatggacagcttttcaagggtggcggcttcatttgtgccgcgatactgctctaacagctggccggtggtcaggccaggctgtgacaaacaagtgttgaccagttcggcaaataagccaagtccgggcaatttttcctgattcagaccttccagcggcggcacaagcggtgccagctcgggattctgaaccagcaatcctatcagtatacgcatggttgtgcgttttagctgaggcacaggtcggaccgcgccattttcggattgtttgggcattaaacgttcaagttggttatcgtcaagaatgcccagtttgttacctaattcttgccgtaaatagatacgaagtgtttcacccggtacctgagtaatcagcggcagcgccagcgtactgagctgcgcgcgtccatcgggcgtgctcaaatcgacctgcggcatcaggctgttaaacaaaaacgtggagagcggctgagcctgctccatccgcgcttcgaacgcctctttaccctctttacgcaccagcgtatcgggatcttcgccatccggcagaaacataaagcgtaactgacggccgtcggtcataaacggcagcgcggtttccagcgcgcgccaggcggcttctctgcctgcccggtcgccgtcgtaacagcaaatcacgctgttggtgacgcgaaacagcagctgaatatgttcagcggttgtggaggtacccagcgaggcgaccgcataattaatgccgtactgcgccagggcaaccacatccatatagccttcgacaaccagcaagcggggcggttccgcattatcctgctgggcttcatacaggccgtacagctggcggcctttatggaaaatatcggtttccggggagttcagatatttgggcgtgtcgtcgccaagcacacgaccgccaaaaccgatcacccgcccgcgcttatcgcggatcgggaacatcacgcggtcgcgaaaacggtcgtaactgcgtcccttatcgttggtgaccagcatgccggcatcggtcaacgactgacgattatcctggttgccgccaaaacgctttaacacgttgtcccagccgggaggggcaaaaccaatggcgaatcgtgtgatgacatcgttgcttaatccgcgcgtggccagatactggcgggcacgctcggcgacaggctgcaacagggattgttgataaaacgtgttcaggccgtccattaactgatagaggctttgccgctgatggcgctctatctgggtcagcccgctgcctgcttcaaaaggcacgtcgagattgtgcatggccgccagttcttctacgctttccacgaactcgagcttgtcgtagttcattaaaaagtcgatagcattaccgtgcgcgccacagccaaagcagtgataaaactgtttctcaccgtttacggtgaaagagggggttttttcgttatggaacggacaacacgcgtgataattcttgccctgctttttaagcgtgacccgtgcatcgatcagatcgacgatgtcggtgcgcgccagcaggtcattgataaatactcgtgggattcgtccagccatgtgccccattaccctcagcgccaggcgttcaggtatgtcagatcataaacgaaaataagccgcgcattcctttcggaagcacggccttacaactacaactcagtctgtaaaattgagagcttaagccctcaatacattagtacagacgagtacggcgtgcgttttcgcgagccagtttcttcgcgtgacgtttcactgcggaagctttagcgcgtttacgttcggtagtcggtttttcatagaactcacgacgacgaacttccgccagaacacctgctttctcacaggaacgcttgaagcgacgcagagctacgtcgaacggctcgttttcacgtactttaattaccggcatgtgcctctcacctttgattaaatcggtttgccgctggcatcaacgccagcttatttcaaaatggtgcggaattttactgcaaatgctgctgctttgtaaagcaccgctacccttctttgcaagggacttttgtaagggggacgagtatacacgaactggcaagacggggtgagcaaagttttacaagcatgggcattcgccctacactgcgcggtattgaaaagaggtagaaaccaccatgcgtgtactgggtattgaaacatcctgcgatgaaaccggcatcgccatttatgacgatgaaaaagggcttttagccaaccaattgtatagtcaggtgaaattacacgctgactacggcggcgtggtgccggaactggcatcccgcgaccatgtgcgcaaaaccgtgcccctgatccaggcggcaatgaaagaagcgaacctcagcgcgcaggagatagatgcagtagcctataccgcagggccgggtctggtaggggcgttactggtcggcgcgaccgttggccgttcgctggcctttgcctgggatgtgccggccattgccgtgcatcatatggaaggccacctgttagcgccgatgctggaagacaatccgccggagttcccttttgtggcgctgctggtttccggcggacatacccagctcatcagcgtgacgggcatcgggcattatgaactgctcggcgagtcgatcgatgatgccgccggggaagccttcgacaaaaccgcgaagctgctggggctggattatcccggcggacctatgctgtcaaaaatggcggcggcaggcacggagggacgctttacctttccgcgcccgatgaccgatcgtccggggctggatttcagcttctcgggcctgaagaccttcgcggccaacaccattcgcaacaacggtaacgacgatcaaacccgcgcagacatcgcccgtgcgtttgaagacgcggtggtggatacgttgatgatcaaatgcaaacgcgcgctggatcagaccggcttcagccgtctggtgatggcggggggcgtaagcgcgaaccgcacgctgcgcgcaaagctggccaatatgatgcaaaagcgccgcggcgaggtgttctatgcgcgtccggagttttgcaccgataacggcgcgatgatcgcttatgcgggtatggtcaggctgaaagcaggaacgacggcggatctgggcgttacggttcgtccgcgctggccgctggcagagctgcctgcggcgtgatgatgcatgccggatgaagctcatccggcataaaaactactcttcggtattatccctttcgcgctttttcctgaacttcgtccagatttttgtctcctgcctgcgccacagacgctggatgttgtcatggtgccgcaacaggatcagacaggagagcatggccaccgggaaggtaaactgcggtttaaaccaccagacgtaaaagggcgcaatcagcgcgctgataatggctcccagcgacgaatagccgctaagtaacaccgtcagcagccaggtacccgccatgacgcccgtcaaatcccagccaataggcgcgatcgccccgaacgcggtggcgacgcctttaccgccctggaaatgaaagaagaccggccagatatggcccagacaggcggcaatcgcgataagccccagccagaacggcgtgatgcccaatgcatacgcgccccagacaggcagcatgcctttgaggacatcgaagatcagtaccgttacggctgctcccttgccgccaattcgcaggacgttggtcgctccgggattcccggatccgctctcgcgagggtcaggcagacccgcgatgcggcagaccagaatggcgctggagattgagccgcaaaggtacgcgaggaggatcattccaggcgcgattgcactcataacgctgttccgttttgaaaatgtcgttttattctctgcatctgtggataatacgcataattttttgaaagtggtatccaggttagctaaaaaccaggcggggcgtgatggacattgtatttatagagcaactttcggtaatcaccaccattggtgtttacgactgggaacaaacaatcgagcagaaactgatgttcgatatcgaaatggcgtgggataaccaggctgccgcgaaaagcgatgacgtaaacgactgtctgagctacgccgatatcgccgacacggtgattggccacgtggaaggccagcgttttgcgctggtggagcgggtggccgaggaagtggcagagctgttactgagccgctttgcgtcaccctgggtacgcattaaagtcagcaaaccgggcgcggtagcgcgggcggcaaacgtcggcgtgatcatcgaacgtgggcttaatccgaaacaaaacaattaacttcataattattaaaccaaatgccagtataccggtctgatgtcagggcctgacgcggcttcgctggcgagccgaccgttttgtttactttttaggggtttaattgatgagcgatatgcactccctgctgattgcagcgattttgggtgttgtcgaaggactgactgaatttctgccggtatccagtaccggtcacatgatcatcgtcgggcatctgcttggatttgaaggcgaaaccgcgaaaacctttgaggtggtgatccagttaggatctatcctcgccgtggtggtgatgttctggcgacgtctgtttggtcttattggtattcactttgggcatccgccgcacgagggagagggcaaagggcgcttaacgttaatccatattctgctgggtatggtgccagccgtggtgctggggctgattttccacgataccatcaaatcgttattcaacccgattaacgtgatgtatgcgctggttgtcggcggcgtgctgctgattgccgccgaatgcctgaagccgaaagtaccgcgcgcggcgggtctggacgatatgacctaccggcaggcgtttatcatcggctgcttccagtgtctggcgctgtggccgggcttttcccgttccggggcgacgatttccggcggtatgctgatgggcgtcagccgttacgcagcttctgagttttctttcctgctggcggtgccgatgatgatgggcgccaccgtgctggatctctataaaagctatcatttcctgtcgatggcggatttcccgatgttcgccgttggctttatcacggcctttattgtcgcgctggtggcgataaaaacattcctgcaaattattaaacgtatttcgtttattccctttgccatttatcgttttatcgttgcaggcgcggtatatctcgtctttatgtaatttcagacgctaataagccccgccactggcggggttttttatttgtctgaataatgctttccccttcccttagttttgctaaaaaagcaattaactttacagccttaactattaggtttaaaccagccgtgcttatagttaagcagagctaatacttttaactttagggataaaggaaaggtgtacctatgcaattaaataaattaactgcggcgataatattgtctgtcgctgggctgccaacgctggcttatgctgcaaacgtaacaggaaatgacgacaccaacagtttttccgggctggatgcctggatgatgatctcaaaagataatggctattcctggcaggcctataccgacagcaagcagaataatttccccggtacggtggtaggactggtggcgcagaaacaagaactggccattatttcgcacccttatgatccaaacagaacctatcgtggcggcgaaactgtgcgattccttgactattactggacagcgcagtggtgggtggataaaggcattagcccgtcaaccgatccggtctggaaaaagggtgataaggtcgattttaatatctacgcggaattctatttcacaccttataccggtcagaaagcgaaagatctgcaggcaacagaaaaagcaaaagtcgcggcacagcgcaaagtcattggttatttcccggaatggggcatctacgatgcgcacaaaaactttactccggataaaattgactacgccgggctgacccacgtgaactatggctttgcggtgattaaagatggccgggttgtcacccatgacacagaacgggggccggatttgatgcgcaatctcgatcagcgtacagaaatggccggtgtcacccatatgatctctattggcggctggactaactccgctgaaggagtatttgaagcggcaactgccaccgatgccggtattgaaacgctggctgacagcatggtgtcctatatgcgcacctggcgtttcgatggtatagatgttgactgggagtacccggatagcgacgctgaaaaaaaccagttcaccaaactcatccagaaattgcgcagcaagctggatgcagcaggtttgcaggatgacaaatactatcagctgtccactgcggcaacgaccaaccacaaaaatatcaaatacattaacccggaagtcaccgcgccgttactggatagcgtcaacgtgatggcctatgacatgcatggtgcctttgatccgatcaccggccacaacgcgccgctgtttgccaacagtaaagatgccgatccaaaactcaattcttcctcggcgatgatggaatacgccaatacctggaaagtgccgaaagcaaaactgatgatgggcatcccttattatgggcgtggctgggggaatgttgcgccgaccgaagtggtgaaaggtttgccgggcttcctggtaagcggcaccgcaaccgtgaaaggcgcatgggatgacgcaggtcagtttaccggcacgaatccatggtatgtgctgaaagaaaaactggcgagcggcgaatatgcgcgttactgggatgcggaatcccatgttccctatctttacagcaaatggaacggtgaattcctgacctatgacgatccgcagtcagtgcaggataaagtaaattatattcagcagcagaatttcggcggcgcgatcatctgggatctgagcggtgatacgccggaacatgagttaggccatattgtcgatgatattctggacaatacccaaccggtaccgggcaacggcgtaaaagcaacgctgttcagggatatgaagttcaaaggcgcgaagctggacgtaaaagaggacattccttgtctgacgaaggtttacgactctgcaaatcattcagcaaatgatatgacgtcttcaatcaacgttgggccaggttcattagggattaccatcttcagtaactgtgagtatacgggcactaaaaccatgatcccggaaacggtagaggaaatgccgtcgtggttaaacgataaaacctcttcggtaaaagtggtcaaagcgctggcgtttaaagacgctgattttagcggcctgagtctgacggttgaagatgacatgcctgcactgaccggcgatgtgagctttaacgatatgatgtcgtccattaaagtggcggaaggctactcggtacgtctgtatagcgataccggttacagaggccgatatattgaagtgaagggcggtcagaatatagcaaatatgagttctgtgaatatgaatgacaacgtttcttccattggcgtaactaaaacgaactgataaccggcccttttctgtccggaaaagggccgttaagcaggatttaagacgcgtccggcagcatatcgccggacgcttttttccacgcctctaccgccgcaattcgccgacgggtcagctcttcacgaatggccgggccgctaaagcctgcgtcaatcacttctctgtttgtcacctgttgcgccgctttccaggcgtcacgcagcagacggccctggtaataatccgtggcttcaaaggtggttctgccgcgcacatcggcttcgctggtgagcgcgatctgctccacgcgctgcggcttgcgccaggcgtcaatggtgtcaaacagcttgacgatggtctgcggtttaaggatgggcagggtgtggatcagatcgtgatattccgccacgagcttcgccagatcgcgcagctcgttgggtacttttaagcgcgcgcagagattttccaccagcttcacacctgccggaccgtggccgtgatggcgcggccagaggtgtttcggcgttaaccctttgccaaggtcgtgacacagcgtggcgaaacgtacatccaggtccgggctgagcatcgccgccatggataaggtcatcagcacatgaatgccggtgtcgatttccgggtgccattttgcgggggcgggcacgccaaacaggatatcgagttccggaaacaggaccttcagcgcaccgcactcgcgcagcgccataaaatagacctgcggattacggctgctgagggcgttttccgtttccttccatacacgttctggcgtcaggtgttccagctcacctgcggcggtcatctcgcgcattaacgccatggtttcatcggcaatacggaaactcaaatgggcgtagcgggccgcaaagcgcgccacgcgcagcacgcgcaggggatcttcattaaaagccggggaaacgtggcgcagcacgcgcattttgagatcgcgaaggccgttatagggatcaatgatcgtgccgtcatcatcctgcgccatcgcgttaatcgtcagatcgcggcgcagcagatcctgctccagcgtgacgtctggcgcggcatagcagctaaagccagtataaccaaaaccggattttcgctcggtgcgcgccagcgcgtactcttcgtgagatttgggatgcaggaacaccggaaaatcacggcctacctgctgatagcccgcgtcaagcatctcctgcggggtggcaccgaccaccacccagtctttatctttaaccggtagctttaacaacgcatcccgaaccgcaccaccgaccagataactcttcacaccgcttccccatggttacattcccgttaatgatacgtaactccggggaagatggcgaatcggcgtcagctcatccagcggtctttgcgtttccggcttgggatcatgtgcggtaacaccagaccgagcagcaggcccgcgcccagcacgccgccgccatacataaaccactgcatgatgatcgaacgctgtttgtcatcgatctgaagattggcggcatccactttcttctgcgccacaatcagttcgtttttaagcttctggttttcctgcttcaggccgttgatcacgccgtcgctctgcgccactttctgctgcatttcagccgtgcgctgattccaggtgttgtcgatgttggtcagtttatcggtcagggttttgacctggttttccagatccggtacgcgggtgcgcaggctgggggtgctgttcagttctttttgcgggatccacgcggtgcggccactgctgtcacgcacctgcgcataattggtattgttgtcggtctgtaacaggacaacttcttcaccggcgttcagggtacccagcaggcggtaattatcacccgggccgctgcgtacccaggtgttcagttcatcagaaacgtaacgcttttcttcggcgtgagccacagtagtaacgctaagtgcgaataaggtcagtcctatcaggcgtaattttggcatcaggcagtcgttagtgtcataaaaaagtggaacgatagtagtggcatcagtctgacgaggcaaagtattcggcatcaataagaatcatccaggtcaaacctgccacttctgcgaatttttcaggccgccaatgtctcacagaatggcaatttggcgcaaaatactatctactgacaaacatcaaacgggtaagttcgccgaaattttcactgttgtgacataaccataagtacaagaccatggctcaagaaatcgaattaaaatttatcgttaatccacagaacgtagaaacgctgcgcagccacctgcacacgctgaccactgagcacgttgcgccgacaaaactgctcaatgtttactacgaaacgccggataactggctgcgtgggcatgacatggggctgcgaattcgcggcgtcggcgatcgctatgaaatgacgatgaaaatcgccggtcgtgtggtgggcgggctgcatcagcgcccggaatataacatcgacattgatggaccggagcttgatctggcgcgcttcccggcggaagtctggccggaaggcggcttgccggaggatttagccgcccgcgtcagcccgttgttcagcaccgatttcgagcgggaaaagtggctggtgaatgtcggcgacagccgcattgagatcgcccttgatcgtggcgaagtcaaagccggcgagtttcaggagccgatctgcgagctggagctcgaactgctgagcggcgagcgtgacgacgtgctgaagctggcgcaccagctggtgacgcagtccggtctgcgtcagggcagcctgagcaaggcagcgcgcgggtatcatctggccgcaggcaatgccccgcgcaggatcaaacctaccggtattctgccggtggtgccaaaagccaccattgagcaggggcttgaagccgccctcgaaatggcgctggcgcagtggcagtaccatgaagagctgtgggtgcgcggcgagggcgcagcgaaagaggaagtgatgaaggcgatcgcgctggttcgtcacgcactgacgctgttcggcggcatagtgccgcgaaaagcgagcgctcacttacgtgatctgctgacccggactgaagccaccatcacttctgccgtatccgccgaaaccgcggtgtacagcaccgaaacggcgaaggcgaaactggcgctcaccgagtggctgctgacgcgcggctggcgtcctttcctggatgcgaaaggcgaggcgaaaatcggcgactcgttcaagcgttttgcggatacccatctttcccgccacgccgccgagctgagaaccacctttgcgcatccgctgggcgatcgttatcgcgaccagctgccgcgcctgtctcgtgacatcgacagtgtgctgctgatgtccggcttttataatgaggtgcaggctaaggcgtggattgagaactggcaggggctgctgcacgccatcaaaaccggccagcatattgaaattgaacatttccgcaacgaagccaacatgcaggaaccgtactggctgcacagcggaaaacgctaacccaggcaaaggatcaccgcgatgatgccgctttcctcatccttacagcaacactggcagacggtagttgaacgtctgcccgacgcctcccttagcccgcaggcgaagtcggtgctcactttcagcgattttgtgtgcgacagccttatcgcccatcctgactggctgacggcgcttgaacatgagcccgtcagagcggatgagtggcgggagtatgctggtttgttgcagacgacgctttcacaggtgcaggatgaagccagcctgatgcgcgagctgcgtctgtttcgccgccgcatcatggtgcgcatcgcctgggcgcaggcgctgtcacagatttcggatgaggacatcctgcaacagctgagcgtgctggcggagacgctcatcgtcgccgcccgcgactggctgtatgacgcctgctgccgtgaatggggcacgccgtgcagccaggaggggcaaccccagccgatgctgatccttggcatgggcaaactcggcggcggcgagctgaacttctcctcggatatcgatctgatttttgcctggccggaaaacggcgtgacccgcggcgggcgtcgcgaactggataacgcgcagttcttcacccggctgggacagcggttgatcaaagtgctcgaccagccgacgcaggacggctttgtctatcgcgtggatatgcgtctgcgcccctttggcgacagcggaccgctggtgctgagctttgccgcgctggaggattactaccaggagcaggggcgcgactgggagcgctatgcgatggtgaaagcccgcattatgggcgacaacgacggcacctatagcaacgaactgcgcgccatgctgcggccttttatcttccgtcgttatatcgacttcagcgtcatccagtcgctgcgtaacatgaagggcatgatcgcccgcgaagtgcgccgccgtggcctgaaggacaacatcaagctgggcgcgggcggtatccgcgaaatcgaatttatcgtgcaggtgttccagctgatccgcggcgggcgcgagccgtcgctgcaatgccgcgcgctgctgccgacgctgacggccatcgaccagctgaatctgttgccgcccggcgatgcgaactccctgcgtgcggcctatctttatctgcgtcgtctggaaaacctgctgcaaagcatcaacgatgagcagactcagaccctgccgggggacgatctcaaccgtgcgcggctggcgtgggggatgaacgcgccggactgggacgggctgatgcaaagcctggcgacgcacatggcggcggtgcgccgggtgtttaacgaactgatcggcgacgatgaatccgcgtctcctgatgaacagctgtctgagcaatggcgcgagctgtggcaggacgcgctgcatgaagaagacaccacgccagggctggcgcatctgtctgacgacgatcgccgccgcgtggtggcgctgatcgccgacttccgtaaagaaattgataaacgcaccatcggcccgcgcggtcgccaggtgctcgatcacctgatgccgcacctgctgtgcgaggtctgctcgcgggatgacgcgccggtgccgttgtcacgtctgacgccgctgctgaccggcatcgtcacgcgcacgacctatctggaactgctgagcgaatttcccggcgcgctcaaacacctgatctccctgtgcgccgcctcgccgatggtggcgagcaaactggcgcgttatccgctgctgctggatgagctgctggatacccgcacgctgtaccagccgacggcgatggacgcctatcgcgacgagctacgccagtatctgctgcgcgtgccggaagaggatgaagagcaacagctggaagcgttacgccagtttaagcaggcgcaaatgctgcgcgtggccgccggtgacatcgccggtacgctgccggtgatgaaagtgagcgatcacttaacctggctggcggaggcgattattgacgccgtcgttcagcaggcgtggacgcagatggtggcgcgttacgggcaaccgactcatcttcaggatcgggaagggcgcgggtttgcggtggtcggctacggcaaactcggcggctgggagctgggctacagttccgatctcgacctggtgtttttgcatgactgcccggcagaggtgatgaccgacggcgagcgggaaatcgatggccgccagttctacctgcggctggcccagcgcattatgcacctgttcagcacccgtacctcgtcgggcattctctatgaagtggacgcccggctgcgtccgtccggcgcggcggggatgctggtcacaaccgcagaggcttttgcggattatcagcagcacgaagcctggacgtgggagcatcaggcgctggtgcgcgcccgcgtggtgtacggcgatccgctgctgaaaacggcattcgacaccattcgccgcgaggtgttgatgacgccgcgggaaggcgaaaccctgcaaaaagaggtgcgcgagatgcgcgagaaaatgcgcgcgcatctggggaataaacataaggatcgttttgatctgaaaaccgatgagggcggcattaccgatattgagtttatcacccagtatctggtgctgcgccacgcgtgcgacaagccaaagctgacgcgctggtccgataatgtgcgcatccttgaactgctggcgcagaacaacatcatggatgacgacgaggcgcaggcgctgacgcaggcctacaccacgctgcgcgatgagctgcatcatctggcgttgcaggaacaacctggccatgtggcgtggtcatgctttatggaagcccgtcagcaggtcagcgccagctggcagaagtggctggtggaaccgtgcgcttaaccgccagtgtggtattatcgcgcgcaaaatttttgaaattgcctggagtctggaatgaaagtaacgctgccagagtttgaacgtgcaggtgtcatggtggtcggtgacgtcatgttggatcgctactggtacggcccaaccagccgtatttcaccggaagcgccggtgcccgtcgtgaaagtggataccatcgaagaacgtccaggcggcgcggcgaacgtggcgatgaacatcgcgtccctgggggcgaactcgcgcctggtgggcctgaccggcatcgacgatgcggcgcgcgcgctcagcaaaacgctggctgacgttaacgtcaaatgcgattttgtttctgtacccacgcatccgacgatcaccaaactgcgtgtactgtcgcgcaaccagcaactgatccgcctcgactttgaagaagggttcgaaggcgttgatcctgagccgctgcatgagcgtatcagccaggcgcttggcaacattggcgcgctggtgctctctgattacgccaaaggcgcgctgacgacggtgcagcagatgatcaccctcgcgcgcgatgcgggcgtaccggtacttatcgatccgaaaggcaccgattttgagcgctatcgcggcgctacgctgttaacgccgaacctctccgaatttgaagcggtggcgggcaagtgcaaaagcgaagaagagatcgttgagcgcggcatgaaaatcatcgccgattttgacttctccgcgctgctggtgacccgctccgagcagggcatgacgctgctgcaaccgggcaaagcaccgctgcatatgccgactcaggcgcaggaagtgtatgacgtcaccggtgccggtgatacggtgatcggcgtgctggccgcgacgctggcggcaggcaacacgctggaagaggcctgctatttcgctaacgcggcggccggtgtcgtggtcggtaaactgggtacctctacggtatcccctatcgagctggaaaacgccgtgcgcggtcgttcagaaaccggcttcggcgtgatgaacgaagaagaactgaaacaggccgtggcggccgcccgcaagcgtggcgaaaaagtggtgatgaccaacggcgtgttcgacattctgcacgcgggccatgtctcttatctggcgaatgcccgtaagctgggggatcgcctgattgtggcggtaaacagcgatgcgtccacgaaacgtctgaaaggggaaacgcggccggtcaacccgctcgaacagcgcatgatcgtgctgggcgcgctggaagccgtggactgggtagtgtcctttgaagaagatacgccgcagcgcctgattgccggtattctgccggacctgctggtaaaaggcggggattacaagccagaacagatcgccggtagcgaagaagtatgggcgaatggcggtgaagtgatggtgctcaattttgaagatgggtgttcaaccaccaacatcatcaaaaagatccagaaagacagccagtaagacgaattgcccggcagcgcgacgctggccgggcagtgtcttttatttctgcacgtccgtgtcgacatctaccacgtcaaccggcggaatggccggagccggcttcacttcttctgtggtgtggcgattttccagatcgctgatgcgttgctccagcagcgccagcttctcgcgggtgcgcagcagaacctgagtctgcacatcgaattcttcacggctgaccagatcgagacgcgtcagttgcgattgcagcgtctgacggatttttttctcgacgtcttcgccaaactcgcgaatgcctttcggcatggactcgtgaacctgacgggcaatctgttcaattttcttcgggtcaatcatagtcgttccctgttcgtgtgggtaatagcatacattgtagcgtgttaagcgcagtgttaaaccagatttgtttaccacacgggcattgccgccaataatcaatagcgttatagttattgcgcttattctcagggcggggcgaaattccccaccggcggtaaatcggcagctacgccgaaagcccgcgagcgcttcagatgcaaatctgaaggtcagcagatccggtgtaattccggggccgacggttagagtccggatgggagagagtaacgatccagacgggcgaggcccgttcacgttatttttttgccgctgtgcggtactcctaagactgccctgattctggtaaccataatgttaatgaggtttttttaccatgaatcagacgctgctttcttcttttggcactccttctgaacgcgttgaactcgcgttaaccgcactgcgcgaaggccgtggggtaatggtgcttgacgacgaagaccgtgaaaacgaaggcgatatgattttcgccgccgaaaccatgaccgttgaacaaatggcgctgactatccgtcacggcagcggcatcgtatgcctgtgcctgaccgacgagcaccgtaaacagctcgacctgccgatgatggtcgaaaacaacaccagcgcttacggcaccggttttaccgtgaccatcgaagccgcgcatggcgtgaccaccggcgtttctgccgctgaccgcatcaccactattcgcgctgctatcgccgatggcgcgaagccgtccgatcttaaccgtccgggccacgtattcccgctgcgcgcgcagccgggcggcgtgctgacccgtggtggtcacaccgaagcgaccatcgatctggtgtcgctggccgggtttaaacccgcaggcgtgctctgtgaactgaccaatgatgatggcaccatggcccgcgcgccggagtgcattgcctttgcgcagcagcacaacatggcggttgtcaccattgaagatctggtggcctaccgtcgtgagcatgagcgtaaagccagctaagcgttaaaaagccgaataaaaaatccgaagtcagtttcctggcttcggatttttgcattttaacgctccgctattttccccggctaagctttattccccaggcaacactcataattactagcaggataaagcaggtgccaaatgccagcaggcaggcctgcgccatgttcatgaaatgccatggcgggatcagataccagccttccgactgctgatacagatcgataaaccatttctgcacgctgctcagggtcacgccatccggtactacgggcgcatcataaccgcagtcgccggtgggtttaaaccactccggcgcccaggacgccagcggcaaattaaacggaaaggtgggttccgttgagcatccctgaacgccaaaaagcgcgtccggatccgggttatgcaccgcgtaatgaatgccgttcagcttgatggcatatttcatccctatgatgctgccgtaaaacgccgccacgcagcccgttaacttcagcacaaggtttttagggttaatggccgcgactatccccccgaataccatcacgaacatggcgaaacggatataaacgcactgctcgcagggagccatgtagagatagatctggaaaaacgaatgcgccagaacgatcagcccacccatggcagccaccattaacagccataaaaagcgcgtctcctgccagcggactaaggtgtccaccggcgaggtttttagcgagcgccataatcccttaaggaaattcataggcactatccctgtttagccgccagctctttgatgagttcagccatggagtcgatggattttatatttttggtgtagataaggtatttaccgttcaccacgtaagccggaacgccctggattttggccacgtcatagctggctttccagcgttcgtagagcgcctggacctccggtgttttaacggtttcgtcgaattccgcgcgggtcatgcccaccgcttccagtcccgtcttcaggaaatcatccgcaccgccatcccaccgctctttcttatcgtggtaagcctggtaataagcaaatttcgcctttttaaacagcgacttctcatctaacagcgacgtacccgccgcctggtctttcaggatcaaaatggcaaataattcgctggcctgtttgccgtatttccctttggtttccaggtggaagggggtaaatgctgccacatcggcgacttttgcagaaaccgggccggtgacggctttgtcatatttataacaaaacgggcagtcgtagctgaaaaccttaattaaggttttatcggcattggggatcggtttttccagcacctgataatccgtgccttccgtaaacgccgatgccataaagggcatcatgagcgcggataacaccactgcgctacgcagcagagccttaagatatttagtcagcataatcattccttaattaacagataaaatgcagcgcatcacttaaacatattctgcggatgcatcatcagcgcgcgataatgagtctggttaggtttgtcagataacacatcaatttcgactttaacttctttggtcttatagtcgatttcattcagcttaccgatagtgggctgaccgacgtcaaacaggtgaatggaaccactgaagccgaacatagtgtcacggtctttctgatattcaatgaccgaggtgatggggctgtaaaaatcatatccccgatctttgccgtattcccacacttgctgcaccgtcatgtttttctcgtcaattttgtattccacaaagcgcgagtatttcatggtgggcagagcgggttgctccagaccacggccatcgccattatcaaagaccgtcagggtgcctttgctggacaaccaggcggtatgctgggtataagcgaaatcaaaatcggtgttctggcacttgccgttttcatcgcaggtgagcggtttgccatctttccccacgggtttcagcaatttaggcgcaagcttttcgttccagccttttgacggcgcgaggatccatttcacctgcttgtcccggccgattttcaccacgccctgatgacgggaggagagaataatcgagtcatctttggcatcgtaggcaatggagttcacgtgcgcccagttgcggcccggccccacgcctaacgcatcgccatagggcgtatcaggctccagcttcgcctgctgcccggcatgtttcagatcgacgttaacgcataccgccccggcgtccagcgcgcccagcagactgtcgcgcaggggatcgaggattttattcagatcccagacgtcaaggacgcgtccggacttgtccacttcgatgatgtgatcgcgaatggtgtgaacatgcagcccgtcatcgcgcttgtagttgcgtttgcccacgcgcagtaacacggtgcctttaggcgtttccagcgactcgtgggtggcgtccaggaagccgcgcggtaatttatgatcttccagcacctggccgagcatatcgaattcataccagtgctgaccctgcaccgccgtaaaggtgccgcgcggcgtttcgcggatccccatcagatagccgcgtttattaatatcgacatctttgccgtcatagagcgcgtcctgctccagccaccagcggtattccccctgggtgtccactacaaaagtgaagggggcaatatcgaacggcagcgcgccgcctgcgggaccggcatcaaggatctccgcatttttatctttttcgccatgccagtgcagatcggaaccctgcggcgtaaaggtgtgggtattcaccatataaaggcgatcttcaaaaccgggagcgactttaatcactttggtttgttgcagatcgctgaaggaacggttatcgacataatggttcacgatagcggatgtcgtaataacgtaatcctcttttacgggtttaccgttttctttgtactccaccgtgaccttattattgtatttttgatataaaccaaaaaccggaatgccatcgtaattcctgagtgacgcggcacccacggcatagctgatgggcacgcctttttcccctttgccatgcaccgtaactttcacatcggaaatgttatggctgtcgagggaaattaacgcggtgagcggggcattaccgtaggggtcgacaatgactgaacctaattttcctgccggtggcgcaggctgaaatccggcggcgagggaactggcggttgtcaggctaaaggataatgccatgccagcgattaacagcttctggtagggtttgagcataataaaattccttttttgacgactttaatcattcataataaatatgattttgccgtttattgagcggagttatactttcatgattaatagcgataccgaatctgtggtgagtaataatatgtatgaactgcacagtgataataagcctgtgcgtgcgcgggtaaatcatcctgataaaattatgtgagccgcttccatagcttttatttttaagaatatataaagatgtttattgctgttagcaggtgtttatatgatcggtatcagtttataagcgtaaaagtctgtcactatgagaaaatatgcgcgtcgaaagcctccgcgcgaaagcagattatcaggagagtaaaaatgtttatcgcatggtactggctggtgatcatcggcgtggcaatcctgggctacgtctgtcatataaaacgctactgcgccgcctaccggcaggacagagacgccctgctggcagggctgcaaaagctcagccagagtaaaaaaggaaaagaggggaaagctgccggacagcctccggcagccgcagagaaagacgcttagcccacgcccagaaactgtagcagcaccaggctcaggcccatcaccgacatgccgcacagcacgccgtagctggggttgttgttggggtcgatctcttttgccagcggcatcagttcatccaccgacagagcgaccataatacccgccaccgccgccatgatcgccgccattaatagcggtgaaagcaggctgccgaggatcagccacgccagcacgccgccgaggatctccgccagtcccgagatacccgcccagaaaatggcggtacgcttagagccggtggcggcataaaccggcccggccaccgccagcccttcaggaatattgtgcagcgctacggcaagggcgatgccaaagccgagttcaagattgttactcgccgtcacataggtggcgatcccttccggaaagttgtgcaggctgatgccaagggtcagcaggatcgccgtgcgcctgaggttacgcggcaatggctcgccttctgtggcgggcagcagatcctgtggatgggcatgaggcagcaggcgatcgagggcaaagtagccgagcaggccgacgataaacatgccatagccgagaacgggtggcatatccggcgtagctaaggccgcaggcagcatctccatcaaagaaattaacagcatgatgcccgcggcaaaccccagtgaaaaagccagcacgcgattggagggcttctggcccattacgccgagaatggcgccaataaaggtggccgcgccagccagtaaggtcaggatcaagggaactgacattaacaactccttgtgataataattctcatttatgttaatgaggatttaccgccaacgcgagcgggtcattcgtcctttacgcatttcttacattcaaaattcctgatgatcttcatcatggttatctgcgtttatccgcttcggaaacagcgtaaggtaaaggcatattattttccgcctttgtaaggatatgaccatgtcagcaccgcgtatgccagcactatttttaggtcacggcagtccaatgaatgttcttgaagataacatttacacccgtacctggcagcatcttggcgagacgctgccgcgtccgaaagccatcgtggtgatctctgcacactggtttacccgcggcaccggcgtgacggctatggcggagccaaagaccattcatgattttggcggttttccgcaggcgctgtatgacacccattatccggcccccggctcacctgcgctggcgcagcaactggtggatctgttagcgccgatcccggtgacgctggatcaggaagcctggggttttgaccatggatcctggggcgtgctgatcaagatgtacccgcaggcggatatcccgatggtgcagctcagcctcgacagcaccaaaccggcggcctggcattacgaactggggcgcaagctcgccacgctgcgcgatcagggcatcatgctggtggccagcggcaacgtggtgcataacctgcgcacggcgcgctggcacggcgaaaacacgccttacccgtgggccgtctcatttaacgattatgtgaaggataatctgacctggaaagggccgacggagcagcatccgctggtgaattatcttgatcatgaaggcggttcgctgtcgaacccgacgccggatcacttcctgccgctgctctacgtgctgggcgcgtgggacggccaggagccggtcactattccggtggaaggtctggaaatgggctcgatcagtatgctgtcggtacagatagggtaaacaaaaaacccggtaagcagaacgccaccgggttttgattattccacaaaaatatgcggatagaagcgcgacagatcctgagtgatcaacgcccgatcttcgcgaatgccgatccccgcaggttgatcgttgataagccagctgccaatcagcacatagctgtcgccgaatttcggcagcgggcagaactcctgcacaatcatgccttcttcgccgtacgggccttccgcctgctcaatggtttgaccgttttcaatgatcgacacgtttgcgccttcgcgggagaaaattggcttcaccacgtacttttcaggcgtcggatgctcatcttcggcaaaccaggcgggcagcagatttggatgatccgggaacatctcccacagcatcggtaacagcgctttattggaaataatacttttccacgccggctccagccagcggacgccagcgtcttccagcttggtggagaacatttcgcgcagcatgtattcccagggataaagcttgaacagattgctgatcacctgatcctgcaaatcgctgaactggcccttttcaccgaggccaatgtcttccatatagaggaattcggtggcgataccggcttcggcggcgcagtcctgcagatattgcacggtgccgcgatcttccacggtatcccggcagcaggccatgtgcagcaggttaaaaccatactggtcgcgcagctcgccgaagcgctcgatcagcttttcctgcaggctgttgaactgatcgctgccagcgggcagattgccggcattcagctgatcttccatccacagccactggaaaaatgccgcttcatacagcgaggtcggcgtatcggcgttgttctccagcagtttaggatcgcccacgccgtcccacgccagatcgaggcgggagtaaagcgagggttgctgcgtctgccaggactggcgcacaaagccccaggtgtgtttaggaatgcggaatttggtcatcagcgcatcgctggcaatcaccttttccaccaccttcaggcacatctggtgcagttccgccgtgacgtcttccagcttctcaacctgtgcgagggtgagcttgtagtaggcgtcctcacaccagtacggctcgccgtacatggtgtggaagttaaagccgtactcggtggccttttcgcgccagtccgggcgctcaacaatactgattctttccatgcctatcagccgcccattgagcgtgaagaggtaccggcagcgctgcgctgcatggtggattgtttagcgactgattcgccgaacccgccgcgggtcacggtggttgtggtggccggtttaggggccagcgcggttttcggcacggtagcggtacggcctggctgtgcggcgccgtagcctttaccggaggcatcggtgtactggccataagccgggctggccgggttgcgtgaggtaaacagcggctgctgcgcgaagcctgcgccgccgcccatcagacgacccatcatataacccgccatcagcggcatccagaagctgccgctttgctgggtttgcgcctggttttccggggccatacctgcctgagcaggggcctgctggcactggccttcgccaaattcagccacacagtcttcacgcgtggcgtatttcggcgcggtacgttcggcttcttttttcgcgttattaaaggcagtggtacattccgcacttttgcccgggttggcgctggtgcagtcgtccgcattttgatacatggataccgtttcgtcgctttgctcgcagcctgccagcataaacacggcagtgacggcaaaggcgaccggcgtcaggtggcgtgcgctccagcttttgcggaacgtcgcatgattaatcgtttttgtccgtttcatagatgtcttccagaacccagagttacagcaaggtgaataatgctcaggatagaggatgagtggtcgaaaatgaagcgcgatcgggccggaacgggtggtgaagagggatctttacgttgtcttacgttgaaatgggggctgacgcccccattgaacagattaacggctaaacggattagcgccgctacgtgaactattggttgccacaggggcgtcagcggtggtcgcggactgtgcgtcggcggcgatgttctgcacgcgcgcatcctgctgtggattttccggcgccacggcttcaggcgtggttgaggtcggtttacccagcgtgctgttcagcgccagcagatcctgctcgttcagcgtaccgagggcggatttaatattcagctggttgatcagatagttataacgcgcgctggaaagctgctgcttggcgttatacagcgccgtggtggcgtccagcacatcgacgatggtacgcgtacccacggagtaacccgcttcgctcgcatccagagaactttgcgcagaaaccacggcctgctcataagccttgatgctgctgatggacgcgttaacgttgttaaaggaggaacgaacgttctgtaccacgctgcggtgcgcggtttcgagctgctcgctggcgccaacgaagttgtactgcgcctgcttcacctgtgagttaaccattccgccctggaaaatcggcagagagaagttcaggccgactttgttctgaccaacgttgctgtcatcaaactgcgcattgttggttttagaaccgctgtacgaggtatcagacacgccggtagaggcggtgagatccagggtcggcaaatggccgtcctgcgcctggcggatctgctcacgcgccaggtcctgattcagacgcgcctgcaacagcgacaggttgcggttttctgcttctttcagcagggcattgaccggctgcggcttgtcagttttgaagttatcgacgttcagggaagccagttccggatagtagttaccggtgacctggcgcagctgctcaacggcgttatccagattgttgcgcgcggtgacttcattcgccagcacggtgtcgtactgtgaacgggcgttctgcacgtcggtaatggcaaccaggccaacgttaaaacgctgcgttgtctgatcgagctggcgatagatcgcctgtttctgtgcttcggtgtaagagagcgaatcaatggcgctcaacacgttgaagtaagcggtggcggtattgagaatcaacgtctgctggtcagtctggaaggtcacatcctggataccagcggctttttcctgcagcgtcagcgcgcgccactttgacatgtcaaacagggtttgtgtaagttgcaaagaggcgctggtggcattggagttcacaccattgctgtcgcggaagccattgctgtaggtgtaatccgcacccaaacccagctgtggcagtaacgggctgcgtgcttcgttgattttctcgaatgcggcatcacggtctgctgcagacctgcgcagttccgggttgcttaaacgcgcctgcttataaacctgcaacaggttttctgcctggctcatggcgctgaaacctgcaaggctcaggccgattaggatggggagcaatttcttcatttgcattccttgttgtgaagcatgatatagcgctgatcaaagagtaaaaataattgccgattctagcagagactagcatgacaaaaggttggcgttacgtgccatctggcgttaatttgcaccaatctaccacaaggtacagtaaacggcagtgctggtgccttgaaatccacaatttcatcattatttaggggcgggatgaatcatgaataaagacaagccggttgccacgactttcaccaaaaatgatgtagaaattattgcacgggaaaaactgtacagtggttttttttcgctcgatttgtaccgctttcgtcatcgccttttcaacggggaaatgagcaacgaagtacggcgtgaaatttttgagcgcggtcacgcggcagtgttgctaccctatgaccctgtgcgcgatgaaatcgtactgatcgagcaaatccgtatcgccgcttatgacaccagcgagacgccctggctgctggaactggtggcgggcattatcgaagagggtgaaaccgttgaggacgtcgcgcgccgtgaagcggtagaagaggcgggccttgaggttggccgcgtgaagaaatttatgagctacctggcaagtccggggggcaccagcgagcggttatcgctgttggttggtgaagtggatgccacagaggccaaaggtatacatggtctggtggacgaaaacgaagatattcgtgttcatgtggtgagccgggaacaggcttaccagtgggtagaagaggggaaaatcgacaacgcagcgtctgtcatcgccctgcaatggctgcagctgcattatgaagcattgagaaaagagtggataaaatgaagcgttacacacctgacttccctgagatgatgcgcctgtgcgaaaccaacttcgcgcagttgcgacgcctgttgccccgtaccgacgcacccggcgaaacagtgagctatcaggtggcaaatgcgcaataccggttaaccattaccgagtccacccgctacactacgctggtggaaatcgaacagacggttccggcgataagctactggagcctgccgtcgctgacggtacgtctgtatcatgatgcgatggtcgctgaagtgtgttcaagccagcagatttttcgcttcaaggcacgttatgattacccaaacaaaaagttgcaccaacgcgacgaaaagcatcaaattaatcagtttttagccgactggctgcgatactgtttagcacatggagcaatggcgattccggtttgttagcgtcgtgaaacctaaggacaccatttggaaagcctgttaaatctggggctggctggtgaggccaacatcaggatcttacaaataaccgatactcacctgtttgctgagaagcatgaaacgctgttaggcgtgaacacctgggagagctatcgggcggtgctggacgccatccgcgcgcaacagcgcgactgcgatcttattgtcgcgacgggcgatctgtcacaggatcacacggctgcggcctatcagcattttgctgacggcatcgcaagctttgatgcgccctgcgtatggctgccgggaaaccatgatttccagcccgccatgtacagcacgcttcaggatgccggtatttcgccatcaaaacgcgtttttgccggcgaacactggcaaattctgctgctcgacagccaggtgttcggcgtgccgcacggtgaactgagcgagtttcagctcgactggctggagcgtaagctggcggatgcgccggatcgccatacgctgctgttgctgcaccatcatccgctgccggcgggctgcggctggctggatcagcacagtctgcgcaatgcgcaggagctggacaacgtgctggtgcgcttcccaaaggtgaaatatctgttatgcggccatattcatcaggagcaggatctggactggaacggtcgccgtctgcttgccacgccgtcaacctgcgtgcagttcaaaccgcactgttctaattttacgctggataccgccgctcccggctggcgctggctggaactgcgcgccgacggcacgctgcatacggaagtgtgccgcctgcaaagcacgcagtttcgtccggataccgcttcagaaggttactgatgtctacgcttctttatttgcatggctttaacagttcgccgcgttcggcgaaggccacccagatgcaacagtggcttgccgggcatcatccgcacatcaatatggtggtgccgcaactgccgccctatcctggcgaggccgctgaactgctggaatcgctggtgctcagacacggcggcgagccgctcggtatcgtcggctcgtctttaggcggctattacgccacctggctgtcacaatgttttatgctgcctgccgtcgtggtgaacccggcggtgcggccctttgaattactgcgggattttctggggcagaacgagaacccctacaccggtcagcaatatgtgctagagtctcgccatatttacgatctaaaagtcatgcagattgacccgctggaagcgtcggatttactctggctgctacagcaaacgggcgatgaagttctggattaccgccaggccgtcgcgtattacgcgtcatgccgccagacagttatcgaaggcggaaaccatgcctttgtgggctttgacgatcatttcacacagattatcgatttcctcggactgcattaagtctgtcgggaaacgatgcgatcactatctacgaacaaaccatgacgcaatcctataacgctgatgccattgaggtactgaccgggcttgagccggttcgccgccgtccggggatgtataccgacaccacccgcccaaaccatctgggccaggaagttattgataacagcgtggatgaggcgctggcaggtcacgcgaagcgcgtggatgtcattctgcatgccgatcagtcgctggaagttatcgatgatggccgcggcatgccggtggatattcacccggaagagggcgttccggcggtggagttgatcctctgccgtctgcacgcgggcggtaaattctccaacaaaaactatcagttctccggcggcctgcacggcgtggggatctccgtcgttaacgccctgtcccgacgcgtggaagtgaacgtgcgtcgcgatggcaaaatctacaacatcgcttttgaaaacggcgagaaggttaaagagctggacgtgatcggcacctgcgcgaaacgcaacaccggtaccagcgtccatttctggccggatgaaagcttcttcgacagcccgcgtttctctgtctcccgtctgacgcacgtgctgaaagccaaggcagtgctctgccctggcgtggaaatcacctttaaagatgaagtgaacggcagcgaacagcgctggtgttatgccgacgggctgaacgactatctgggcgaggcggtaaacggcctgcccacgctaccggaaaaaccctttgtcggcagctttgccggtgacgtagaagcggtggactgggcgctgctgtggctgccggaaggcggtgagctgctgacggaaagctacgtcaacctgatccctaccatgcaaggcggtacgcacgttaacggtctgcgtcaggggctgctggacgcgatgcgtgaattctgcgaataccgcaatattctgccgcgcggcgtgaagctgtcggcggaagatatctgggatcgctgcgcttacgtcctgtcggtcaagatgcaggatccgcagttcgccgggcagaccaaagagcgcctctcttcacgtcagtgcgcggccttcgtgtccggcgtggtaaaagatgcctttacgctctggctgaaccagaacgtccagtcagccgaaatgctggcggaaatggcgatttccagcgcccagcgccgtatgcgcgccgccaagaaagtggtgcgtaaaaagctgaccagcggccccgcactgcccggcaagctggcggactgtaccgcgcaagatctgaaccgtaccgaactcttcctcgtggaaggggactcggcgggcggctcggcgaaacaggcgcgcgatcgtgaatatcaggcgatcatgccgcttaagggtaaaatccttaacacctgggaagtctcctccgatgaagtgctggcgtcccaggaagtgcacgacatttcggtggccatcggtatcgatccggacagcgaagatttaacccagctgcgctacggcaagatctgtatcctcgcggatgcggattccgatggcctgcacatcgctacgctgctgtgcgcgcttttcgtgaagcacttccgcacgctggtgaagcacggacacgtctatgtggcgctgccgccgctctaccgtatcgatctcggtaaagaggtgtactacgcgctgaccgaagaggaaaaagccggtgtgctggaacagctgaagcgcaagaagggaaaaccgaacgtccagcgctttaaaggcctcggcgaaatgaacccgatgcagctgcgcgaaaccacgcttgatcccaacacgcgccgtctggtgcagctgaccatcagcgatgaagacgatcagcgcacgacggcgatgatggatatgctgctggcgaaaaagcgttccgaagatcgccgtaactggttgcaggaaaaaggcgatctcgccgaacttgacggctaatcagcaaataacagcggggcgaattatcgccccgcttttttttatgctttcgccagcctgagctttatcatcagattgcgggtctcgttaataatattcttctttaagcgcaggaaaggaaaaacgaaccacagccacagcacatattttttatggtcctgcgaacttaacttcaccaccggcgttttcagtcgcgcatactgactcttctttatttgttttaacgccgttttatcgacgctggtataaacaaatccgcactcctgataattctcgatatgataaaaccccgcgcaggcgtttattctggcgatggcgattgaaaagggaacagggccggtggtacgcagcacgcccattcgcccgatgccatacacccagggtttgtaagaccttatgcgtgacaccacttcatcgatcacccctttgatccacggcgaacgcgcgcagaccgtgatgttccactgctgatactcaccgttttccagaaaagagagctccgcgtgacgacctgtctgtttccgccgcccgcaggccgtgctttgccagctgcacagcaatagctgacagtcgtcagggataacctcatccagcggtcgcgagcaggcgcttttgatatccagatagacaccgccttccacgtacagcatcagataacgaaaaaaatccgcccgtgccgcgccgtattcagggttgatcataagccaggtattcagcatctcttcgccatagtgctggcgaataaaatccttaatcatgctggtgtcataaaagtgataggtccagtgcggattattcttctttaatttttcaatagaagtaacgatgctctccggtaatgcataccaaccttttgtgtatatttgatgaattttttttggcaccttgttcataggcatccttcgaaacagaaaagtccggatcctgctatcaaaaagaaataagaaaacgtatcagcgcttattcagaccatcgtcctctgtgaggagttccgtctttcagctattcagaatgtatataaaagtaaaatataccgggaaggaataaacgataagaaaaagcttatttgccggacgctttctctgcggatttacctgaaggcgaatgatttttccggtactgcaacggggtttcaccgatacccttccggaaggcgctgataaagtaagtgacatcggaaaaaccgaccaccgccgccacctcgctgacgctcagcgggctgtgcaaaagcgcttcacaggctttgcgcaggcggatggtgttcaggtattgatgcagatgctcccccgtctccacatgaaagcggcgggagagatagctgcgcgatttccccagctcctgcgccagggtgtcgaggctgaatttctgccggtagttctcctccagccagaacatcacctgcgtcgccagactctggcggttatccgacggcgcggcgttatcgtccggcagcatagtgaacaacgtcagcagcaggcaggcgacctgctcagcattcagcggggcggtggcggcaaggcgggcatacagactgaacagattatcaatatgggcatgctgggcagaagcatccaccaccagcgccgggccgccgcgcgtcgacagcttttgcaggcgctgctggttttgcgggaaatcccgcaggatcttgagcactgcatgctgatcgacatgaatgatagtgcggcgataacagtcctgcgcctgctcgtcgaccatcaccttatgcagcgtgaagggcgggaaaataaacagccgccccggtcgcatggtgtactgccggttatcgacgatggcgatgccgtagccctcctcgacgtacagcacttccagacattgatgccagtgatggtaacgcaccgtattggcaaacaagcggctgaacgacactatggcatcgttaagggtaattaactccagacgatccgacggccacctttcggacatggtgcaataattctcaacttttaccggtcaaaaagcatttataaaccctttttttaaattttctcaacacccagttcaaaagagttctgcgggtgtgacaaaggtaacatttctggctgtcgcccattcactatgcttgtgccacttgattgtgagaggcagaaccatgctgacggcgactacagaaacctcaaatacattgtcttcccgcgcggaggtggttgatgcattaatgaccatgctcggcgcgctggatcggcagtttcccgcaggaagctcaggctttccattaggggatacctgcgcccattacggcgctgatattgccatgatggagggattgtcacgcgcgctgtggggcgtgtttccgctgatggcggggggcgaacccgtgccgtacagcgataaatatctcacggcgattaaacagggcaccgatccgcagagcgccggatactggggcgataccgggccttacgatcagcggctggtggagatggcggcctacgggctggggctttcgttattgcaggataaactgctggaaagcttcaccgcccgcgagcgggaaaacctgcatcgctggctgaaccagatcactgacgcgcaaatgccggacagcaactggaactatttcgccatcatggtgcagctgggattcaaacgcgccggcctgccctgggatcgcgccgccattgagcaccgctttgagctgatggaagcctattatctgggcgacggctggtactctgacggcccgggccgcccgaaagattattacatctcgatggcgttccacttttacggcctgatctacgccacgctcaacggcgaagacgatcccgcccgcgcgcagatcctgcgcgatcgtgccgcgcagtttgcgcaagattttatttatatgtcggcgaccggaggcgagtcggtgccctttggtcgcagcctgacctaccgtttcgcaatggtggcattctggagcggcgtggcgtttgccgggctggaggtgttctcgccgggcgtggtaaaaggcattattctgcgccatctgcgctggtggctgaaacagccgatttttgaccgcgacggcattctgaccctcggtttcgcgtatcccaacctcgctttctgcgaagactataactcaccgggatcgccgtactgggcgctgaaagtcttcctcatcctggcgctgcccgcggagcatccgttctggctggcggaagagcagccgctgcccgcgctggacaataaacgtgtcattccccatgcgcagcagatcctcgtgcacagcgagaattcacagcatgtgtacatgctcacctccgggcaactggagctgaacaattatgtgaataccgaagccaaatacaccaaattcgcctactccagccgctttggtttcaccattgagcgcgggcgctacggcattaagcacgccgcctgcgactccatgctgctgctctcggaaggggataactactggcgtggccgccgcgagtgcgacgaggtggtggtgcgagacgatcatattttttcgcgctggtcaccctggcataacgtgcagatcgccagctggcttatcccctgcggcgactggcatgtgcgcattcaccacatcaacaccgcccgccatttaaacagtaccgaagggggcttcgcggtgatgaaggcggatccacaactgctggctgacggctgcttgttacaggcccgtaatggcaccagcgccatcctgtctttacccgccggggcgtcacgccaggcggactgcattattacgccgccgaacagcagcgtgatgttcgccgaatgtgccgctataccggtgctgacgggcgagctggcaccgggtgaatactggctgtgttgcgcggttcgcgcaggcgcgcatcaggaggcatttacccgcgccgttccggacgtacagcgtgatgccagcgcccttgtggtgcgtcatccgctatcgggaaacccaattaccatcaaagtataaataccgggcgtcagcccggaataacactcaacctctgtatctgcatgctttcgtcgaggatagtatggctaaaatattaaccaccaaccggtctgaatattacaagatcagtagttttatctttctttatttctttacctggtcggccagtattggtctgctggccatctggcttggacaaaaagcgaatttaagcggcaccgttattggtactgtgttcgcggtaaacggcatattttcggtgatcttaaaaccgatttacggctacattctcgataaaatcggcatgagtaaatatttgctctattttgtcgtggcgatgtcggcattaatggcgccgttctttatttatgtttatcagccgctgttaatgtccaataccatgctgggcattattgtcggggcaatctatttaagctttgcctggtatgccggcgtggcggcctgcgagtcctataccgatcgctacagccgcctgaacggtatggagttcggccagatccgcatgtggggatcgctgggctgggcggtggcgtcatccttctccggcctgctgtttaacctctcgcccgcgtataactttatgctcggcagcgtggcttccatcgtgatgctggtggtgctgttcagcctgaaagtggatacccgcacggcacacgccagtgaagtgctgaccaaagaaaaaatcgccccggctgacgtctatgcactgctgaaaagccgcaaattctgggccttctgcctgtacgtggcgggcgtggcctggatgatgtttatcgccgagcagcagttctcccgctatttcgtcaccttctttgatgatgtgcatcagggcaacgccatcttcggttatctcggtaccgttcagtccggcatggaattcatcatgtatatggtgatcccgctgtttgtgaattacgttggtgcgaagaaaggattattaatcgtcggattactggtaggcgcgcggctgattatttccggcgtttgcgattcccatctgcttatttccgtactcaaaccgctgtatggtctggaaatctgtctgctgctggtgtcggtatttaaatatatcgccgagcatttcgataaacgcgttaacgccactatgtatctgctgggttatcaggcgatgctgtatgtcggaaatgtggtggtgtcgtctccggccgggctgatgtacgaccgtatcggcttcgagcagacctatatcatcatgggttccattgccctgttctttacccttgtgtctgctttcacgctgtccgcctgccagagcaaaatgcgcccgaacgcgccgctggacgtggccggaaataacgcctcacgctaatccctgaagcgggatgatgttatcccgcggtagtcagtcaaaaggaaccgaaatatgttaaataatatcgttgaagaaccgttacgtgcattcccggaggcgctggatcgccaggcgtttagcgacgagatggattccgcccgtaaccatgttctgacgctgatccgccgtcatttaaccgagttcggtgataaatttcccgcagaagcggcggtggacgggcgctatccgctgacggaaaacgttgaatggaccaccagtttctggaccgggcagctgtggctggcatgggaaatgagcggcgacgcggttttccgtgagctggcggaaaagcacgtccgctcgttcggcgcgcgtattgccggtcgccaagataccaatacccacgatctcggctttctttacacgctctcctgcgtggcggcatggcggctgacgggtaaccgcgatgcgcgcggtttctcgctgctggcggcggaggcgctgctggagcgttttcacgtccgggcgaaaattattcaggcgtggggcgatctgaaagatccggcacaggccgggcgcatgatcatcgactgcaccatgaacctgccgctgctctactgggcgacggagcagaccggcgatccgcgctttgccgacgccgcgaaagcgcacgttcagcagtcggcgacttacctgatccgcccggatgcctccacctaccacacctactatatggatgtggaaaccggcgcgccgcgctacggcaacacccagcagggctatgccgatgattcgtgctggtcgcgcggtcaggcgtggggaatttacggtttcctgctcagctatatctataccggcgatcgcgagatgatcgcgctttccaaacggctggcgaactatttcctcaaccgtctgccggaagattatgtctgccactgggatctggcgctgcttggcaccgatgcgctgcgggattcgtcgtctgcggccattgccgtgtgcggattgctggaactggtgaagcacctgccggtgaccgatccggatcgcgcacgctatcagcagtgggcggaagggatcatgtcctcgctgacgaagcattatctggcgggcaacgacgaggcgtgcaacggtctgctgaaacactccgtctatcatcttgccagcaataaaggcgttgatgagtgcagcagctggggagattatttctacgtggaagcgttgatgcgcgtgacgcaaagctggaagctgtactggtgatttgtcttataccctctcccgacgggagagggtaatggggcattacacgccctgctcaagaatacgaatatgggtttccagcacgtcgcctttcaccgcctcgctccacgccttcatgtgcggagtttgcagatgcgcttcaaggtgtgcgacggtttcccacagttccaccatcataatggaatccgggttggtgctctggaagctcacgccggcagcgtgatccaccatcggcgcatagccgtggcagccttcttctttcagtacggtcgggataatcttcgcgaattcgtcgagcaccgcctggcgatggtgttggcccgggcgggtacgaatctcagcaatcactgttaacatggtttaactccttctaaattccatctcacagttaagcaaaaatttccgcaagatgcttgcgatattctgcaatatagcgcggcacgtccggcattttgatcacgtcgttggtgataaaggtcggcagcggatcgaggcccaggaactgattcgctttgtggaacggcaggtaaacgccgtcaacgccaacgccatggaagaactgctctttatcggtgaaagcttccagcggcgcgttccaggtcagcgacagcatataagttttaccctgcaacagaccgccggaaccgtatttcttcgcgccgtcagagcgggtacggccatcgctggcgtacagggaaccgtggccttcagtgaacacatcgtccatatattttttcaccgtccagggcgcgcccatccaccagcctggcatctgccagatgatggtgtcggcccacaggaagttctgcacttcggctttgatgtcgtaatcgctgtcggcacgcacgacgcggacatcatgtccggcgtcacgcagaaaaccctgcgcgacctcggtcagggtgtcattcagctggcctttggagtgggcgaactctttcgcgccgttaacaatcagaatgttgctcattatttatcctcgaataattgcgtttgacgacaatcttacccgcaacgacgggacggtaaaatgagcaaaatgtgcaaagtcttttgctgctggcgcaataatctttaccagctgatgtcgacggcgaaaccagttggcgtcatctgccggaagtgcactgtcatctgatgtagcgccgcgatgcgccgaacaatggacaaccccagcccgctgccggtttcttcctgacctggcgggcgataaaaacgctcgccgatacgcgccagcgcctgcgcgctgacgccggggccgttatcccgtacgcaaaaaccgcgcgccttcagcaccacatccacccgggatcccggtggacagtagcggatggcattctccagcagattgcgcaccagcagttgcagcaacaattgatgcccgcaaaaggtgacgttgtcggcgcgcgtctccagccgcagatcgatgcccgcccgctgcgcgccagaccacgcttccataatggcgctttgcagcagatccgccatcgggatcggctccggctcctccagcccgttcagcgagtcaaggcgcgagagggtaagcaattgctccaccagccgtgacgcgcggtcgatcccctgacgcagattggtcagcgcatgatccagcgacgccggatcgtcctgtgaaagctgcgccacgtcggtctgcaccttcagcgccgccagcggactgcgtaattcgtgggcggcgtcagaggtaaagcggcgttcacgggacataaattcatgaatacgtgtgaacagctggttcagctcatccaccatcgggcgcacttcctgcggcgtgccgtccaccggcagcggggttgtggcgtccggcttacgctgatgcagcaaccgggcgatgcgccgcagcggcgacagctcgcggctgaccagccacaccagaaacagcagcatcaccggtagcgccaccagccagggcgtcagctgcgacatgacgatttccagcgccagatcctcgcggtactctttttcctgcccgacggcgatgcgtcgttcgccgtcttcggtggtcagccacagcacgcgccagtcgtcgccatccacacgcgtatcctgaaaaccgtcctgccggtagtcgtaatccagttcggtaccgttatcgccgtcgttcagcagtcgcttgccgtcgcgggagaaaatagcaaacgccagcacatcgtcatcgagtctgccgtgatgatggcgcaccagctttttactttccggcagcgtctgcgccgggcgcatatcggcgggatcaagcacgctcaggcgttttgccagcagcatttgctgggtatcaaacagcttatccagcgaatgccgcgtttcatgccatgctgccaggcaggcgcagccccaggcaacgatcgccagcaccataaatccggtggtaagccttaagcgcaggctgtgggtcagggtcttaatcatgcgtctcccagtgaatagccaatgccatgcacggtgcggataaaacggctgcccagcttgcggcgcagatggtgaatatgcacatccagcgcaccgcgggagacgtcatcgtcccagttataaagtttttcttcgataagcgagcggggcagaacgcgccccggattgcgcataaacagcgccagcagggcgaactctttcggctgcaacaccagcggttcgcccgccagcgtggcggtgagcttaagcggatcgagcgtcacctcgccgtgggataacgtggcctccacgccgccatgatgccggcgggttaaggcttcaagacgggcggcaacttcaatgagcgcaaagggtttgcagagatagtcgtctgcccccagccgcaacccttccacccgctgctccagcgcatcccgggcggtaaggatcagcaccggatgctgatgtccggcgcgtcgccacgctttaaggatgtcgagtccgtccatgcccggcaggctgagatcgagcaccacggcgtcgtagggcgcctgatccagcgcctgcataccctgcctgccatcggtaaaccagtcgggcgtcatccccagtttgctcagacccgctttcagcccgtccccgatcagcctgtcatcctcaatcagcaatatgcgcataccgtctcctccatggttcctgctggcagttaatacccgctggctgcgggcttgtacagggaaaatcgccggtaagttaacccttccggcattatcgacagaaaaagcagaaaaaatgttggctgttaagaacccgctaagatctgcggtgttaactgatgcttaaggttacccatctacaaggagaagacgtgatgaaaaagaccgcagcactgttaactgtcctgatgtttgcttctgctcccgcactggcgatgcacaccggcctgacggagcatgaaacgggtgaagcgcgccatacggggcagggaaataccgccaccgggaatatcggccatgacggtcatggtcactggggcgataacaccacggcgccgaaaccacagccgaatgcttcaacccggacgcagccacaaagtaacaacagttaatttttcagccaggcctgggtttgcaggcctgttatagttatttactgttagccatcctcaagggagaatcatcatgaaaaacatcgctatgctttttaccgtgctggccctggcctctgctccggcgcttgccgccacccagggcggttttcaggcctctgataccgcaacccaaacgcaaaacggcggcggctttactggcccgtcgggcaccaaaaccacggccgaaaaagcgaaatccctgtccgatgacgcctgggttacgctgacgggtaaaattgaacagcgtaccggcggcgacaactatttgttccgtgatgaatcaggcaccatcgatgtggaaattgatgataaacgctggaatggccagaccgtcaccccgcaggataccgttgaaattcaggggaaagtcgataaagactggaactccgctgaaatcgaggtgaagaaaatcaccaaaaccagtaagtaactggcatcgggccgggaaaccggcctgcttttcatccctcatcatcgcctttcgatctcccccgacaaaaaccgcccggtgcgctaaagttatcgcgcagcacaatgactcattgccttatataaggtagtatctgcggcattatcgccgccggaaaggcgggcgcacacgttgaggaacatcgattaatgagcgatatggcagagcgccttgcgctgcatgaattcacggaaaacgcctacttaaactattccatgtacgtcatcatggatcgggcgctgccgtttattggtgatggcctgaaacctgttcagcgccgcatcgtgtatgcgatgtcagagctcggtcttaacaacagcgccaagttcaaaaaatcggcccgtaccgtaggtgacgtgctgggtaaatatcacccgcacggcgacagcgcctgctacgaagccatggtgctgatggcgcagccgttctcttaccgctatccgctggtagacggtcagggcaactggggcgcgccggacgatccgaaatccttcgccgccatgcgttataccgaatcccgtctctctaaatacgccgagctgctgctgggcgagctggggcagggcacggtggaatggcagccgaacttcgacggcaccctgcaggagccgaaaatgctgcctgctcgtctgccgaatattctgctgaacggcaccaccggcatcgcggtcggcatggcgacggacatcccgcctcataacctgcgtgaagtggcgaaagcggcgatcgcgcttatcgaacagccgaaaaccacgctggatgagctgctggatattgtgcaggggccggattatccgaccgaagcggaaatcatcacctcgcgggcggaaatccgcaaaatctaccagaacgggcgcggctcggtacgtatgcgcgcggtctggaccaaagaagacggcgccgtggtgatcaccgcgctgccgcaccaggtctccggcgcgcgcgtgctggagcagatcgccgcccagatgcgcaataaaaagctgccgatggtcgacgacctgcgcgatgaatccgatcacgaaaacccgacgcgtctggtggttgtgccgcgttcgaaccgcgtggatatggatcaggtgatgaaccacctgttcgccaccaccgatctggaaaaaagttaccgcatcaacctgaacatgatcgggctggatggccgtccgtcggtgaaaaacctgttggagatcctctccgagtggctggtcttccgccgcgacaccgtgcgtcgtcgtctgaatcaccgtctggagaaagtgctcaagcgcctgcatatcctcgaaggtttgctggtggcgttcctcaacattgatgaagtgattgagatcatccgtactgaggacgaaccgaagccagcgctgatgtcgaagtttggtatcagcgaaacccaggccgaggcgatcctggagctgaaattacgccacctcgcgaagctcgaagaagtgaaaatccgcggcgaacaggccgagcttgagaaagagcgcgaccagctgcagggcattctcgcctccgagcgcaaaatgagtaacctgctgaagaaagaactgcaggcggatgccgaagcttttggcgacgatcgccgctcgccgctgcatgaacgcgaagaagcgaaagcgatgagcgagcacgacatgctgccgtctgagccggtgaccattgtgctgtcgcagtctggctgggtgcgcagcgccaaagggcacgacattgacgcgcagggcctgagctacaaagcgggcgatggctggaaagcctcggtgaaaggcaagagcaaccagccggtggtgtttattgataccaccggacgcagctacgccatcgatccgatcacgctaccttccgcgcgcgggcagggcgagccgctgaccggtaagctgacgctgccgccgggcgcgtctgtggaacatatggtgatggcaggcgaagagcagaaactgctgatggcgtcggacgcaggctacggcttcgtctgcacctttaacgatctcatcgcccgtaaccgcgccggtaaagcgctgatcacgctgccggaaaatgcccgcgtcatgccgccgctggaaattaccgacgacagcgatatgctgctggcaatcaccgccgccggacgcatgctgatgttcccggtcagcgatctgccgcagttgtcaaaaggcaaaggtaataagatcatcagcattccgtcggccgaggccgctaaaggcgaagacagcctcgcgcacctctatctgctgccgccgcaaagtacgctgaccatccacgttggcaagcgcaaaatcaaactgcgcccggaagagttgcagaaggtgcatggcgagcgcggacgtcgcggcacgctgatgcgcggcctgcaacgcatcgaccgcgtggagattgactccccgcatcgcgcaagccccggcgacagcgaagagtaatcacggtatcaccgtcccccttttcttacgggggacgtcagttaaaatttcccgaatggccggatgccccgggcataagaggtagctatgctgtttattattcgctctattattattgttgtttacagcattttgctgtgtatttttggttgtatttactgtctgttcagcccacgtaatccgaagcacgtcgccacttttggtcatatgtttggccgcctggcgcctgtgcttggcctgaaggtggaaacccgcctgccgccgaatgccgctgagtttggcaacgctatctatatctgtaaccatcaaaataattacgatatggtcaccgcgtcctgcatcgtgcagccgccgaccgtgaccgtgggtaaaaaaagccttatctggatccctttcttcggcctgctttactggctgaccggcaacctgttgatcgaccgcaataaccgcgccaaagcgcacggtactatcgcccaggtcgtgaagaacattcagaagcgtaatatttcaatctggatgttcccggaaggcacccgcagccgtggccgtggtctgctgccgtttaagaccggtgcattccatgcggctattgccgccggtgtgccggtgatcccggtatgcgtctccaccacctcgaataacatcagcctcaaccgctggaataacggtcatgtgatcgtcgagatgatgcaaccggtggataccaccaagtttggtaaagatcaggttcgtgagctggcagtacactgccgggcattaatggaaaataaaatcgccgcgcttgaccaggaagttgccgtgcgcaatgccgccgataagcgttaattttccctcgtattaaaagtcagttttacatggagcagatatgtcactcagtcggcgtcagtttattcaggcatccggggttgcgctttgtgccggagcggtgccgctgagggcaaacgctgccgggcagcaactgccgttgcccattccccccttgctggaatcacgccgcggccagccgctgtttctgacgcttcagcgcacgcactggtcctttacccagggcacccgcgcccaggtgtgggggattaacggccgctatctggggccgacgatccgcgtctggagcggtgacgacgtgaagctgatctacagcaaccgcatgacggaaaacgtcgccatgacggtaagcggcttacaggtgcccggcccgctgatgggcggcccggcgcgcatgatgtcacctaacgccgactgggcgccggtgctgccggtgcgccagaatgccgccacgctgtggtatcacgccaacacccccaaccgcaccgccgaacaggtctataacggcctggcgggaatgtggctggtggaggatgagatcagcaaatccctgccgatcccgaatcattatggggtggacgacatcccggtgattattcaggacaagcggctggataactttggcacgccggaatacagcgagccgggcagcggcggctttgtgggcgataccctgctggcgaacggcgtgcaggggccgtatgtcgaggtttcccgcggctgggtgcgtctgcgtctgctgaacgcgtctaacgcgcgccgttatcagttacagctgagcgacggtcgcccgctgcacgttatttccggcgaccagggctttctgcctgcgccggtgtcggtgaagcagctgtcgctggcgccgggcgagcgccgggagatcctcgtggatatgaccaatggcgatgaagtgtcgataacctgcggagaagcggcgagcattgtcgatcgtattcgcggcttcttcgagccatcgagcatactgatctccaccctggtgctgacgctgcgtccgaccgggctgttgccgctggtgaccgacagcctgccgatgcgtctgctgccgagcgaactgctgaccggcacgccggtgcgcagccgtgatatcagcctcggcgacgatccgggtatcaacggccagctgtgggacattcagcggctggatattaccgcccagcagggcacctgggagcgctggacggtgcgcgccgacacgccgcaggcgttccatattgaaggtgtcagcttccagatccgcaacgtcaacggcgccattcccttcccggaagatcgcggcatgaaagataccgtgtgggtggatggtcaggtagagctgctggtgtacttcgggcagccgtcctggccgcatttcccgttccagtattacagccagacgctggagatggcggatcgcggatctatcgggcagttgctggtgaatcccgccccctgatttttttcccctcaccctaacgaacggcccggtattctccctctcccctggggagagggccggggtgaggggttaaacaagggtgatttttaaacaataagccttcattctctgcggtattacagcgtataatccccgcccttcgaatttgataacttttccccggaagcattatgagcgctatttccctgatccagccggatcgcgacctcttttcgtggccgcaatactgggcggcctgctttggccccgcaccttttttgccaatgtcacgggaggagatggaccagcttggctgggacagctgcgacatcattctggttaccggggatgcctatgtcgatcatccaagcttcggcatggcgatctgtggacgtatgctggaagcgcagggcttccgcgtggcgatcatcgcccagccggactggagcagcaaagaggatttcatgcgtctgggcaagccgaatctgttcttcggcgtcaccgcgggcaacatggactcaatgattaaccgctataccgccgaccgtaaactgcgccacgacgacgcctatacgccggataacgtggcgggtaaacgccccgaccgcgcgacgctcgtttatacccagcgctgtaaagaagcctggaaagacgtgccggtgatcctggggggtatcgaagccagcctgcgccgtaccgcgcactatgattactggtctgataccgtgcgccgctcagtgctggtggattcgaaagccgacatgctgatcttcggcaacggcgagcgcccgctggtggaagtggcgcatcgtctggcgcagggcgagccggttggcaatatccgcgacgtgcgtaacacggcgatcatggtgaaagaggcgctgccgggctggagcggcgtggattcccgcatcattgaccggccaggcaaaatcgatccgatcccgcatccctatggtgaagatctgccatgcgccgataaccaacctgttgaacccaaaaaagccgaggcaaaagctgtcgttgtgcagccgccgcgcccgaaaccctgggaaaaaacctacgtgctgctgccgtccttcgagaaggtaaaagccgataaagtgctctacgcccatgcgtcgcgcattctgcaccacgaaacaaacccaggctgcgcccgcgcgctgatgcaaaaacacggtgagcgttatatctggatcaacccgcccgccattccgctctctacggaagagatggacagcgtctttgcgctgccgtaccagcgtattccgcatccggcctacggcactgcccgtatcccggcctatgagatgatccgcttttccatcaacattatgcgcggctgctttggcggctgctcgttctgctccattaccgagcacgaagggcgcattattcagagccgctctgaagattcgatcgtgaacgagatcgaggcgatccgcgacacggtgccgggctttaccggcgtgatctccgatctcggcggcccgaccgccaacatgtatatgctgcgctgcaagtcaccgcgcgccgagcagacctgccgccgtctgtcgtgcgtctatcctgacatttgccagcatatggataccaatcatgagccgacgatcaatctctatcgccgcgcccgcgatctgaaaggtatcaagaagatcctgattgcctccggtgtgcgttatgacatcgccgtggaagatccgcgctacattaaagagctggcgacccatcacgttggcggttacctgaaaatcgccccggagcataccgaagaagggccgttgtcgaagatgatgaagccgggcatggggagctatgaccgctttaaagcgttgttcgacacctactcgaaacaggccggcaaagagcagtatctgatcccgtactttatctccgcgcaccccggcacacgcgatgaagatatggtgaacctggcgctgtggctgaagcagcgacgcttccgcctcgatcaggtacagaacttctatccgtcgccgctcgccaactccaccaccatgtattacaccggcaaaaacccgctgggtaaaattggctataagagtgaggatgtggtgatcccgaaaggggataagcagcgtcgtctgcataaagcgctgctgcgctatcacgacccgaaaaactggccgctgatccgtcaggcgctggaagagatggggaaaaaacatctgattggcggacgccgcgactgcctggtgccgtcgccgaccattgaagagatgcgcgaagcgaagcgccagaaccggcatactcgcccggcattgaccaaacatacgccggtggcgcatcagcgtcagacgccggtcagcgccagaaaacgcagtaaggttgccggggggtaagcctgttgcccggtggcgcttcgcttaccgggcctacaggccgttgcccggtggcgctccgcttaccgggcctacaggctgtaggccggataagacgcgtgcgtcgccatccggcaatgaattacccgccgaactgatccgggtccgggccaagacgtttgccctgatccagtttggcgatttcactcagttcatctttatccagacggaaatcccacacatcgaagttttccgcaatgcgcgcaggcgtaacggatttcgggatcaccaccagaccctgatccagatgccagcggatgacgatttgcgccggagtcttgctgtatttgtctgccagcgagcggatcactttctgatcgaacacgccttcgccgccctgcgccagcggactccaggattcagtctggatcttatgggtggcgttccaggcatgcagctgacgctgttgcagcagcggatgcagctcgatctggttgatcaccggcgtcacgcccgtttcatcaatcagacgctgtaaatgcgcgatctggaagttacacacgccgatgcttttcaccagcccttgttcctgcagggcgatcatccctttccaggcttccacatagtgatcgatagccggtaccggccagtgcatcaggtagagatcaacatgatccagctgcagtttatccagactttcctgcaatgcttcctgcgggcgtttttgatcgtcattccacagtttcgtggtgatgaacagctcctcacgcgggatgccagcgctctgaagcgccttgccgacgccttcttcgttcttatacgcggcagcggtatcaatggagcgataacccacttccagcgctttatgaatggcggagatcacttcctcattgcccgctttccacacgccgagacccagttgcggcatgatgttgccgtcctgaagcttgataacggttggatttgccatgcattcctccttttatgaaatccaccaggcatacgcctggtgaagtggtgtgccttaagtctggacgaaaagcccaaaaacgaaaggcgcagaagaaaaaacctttagcgagccgcttcgtagatacgacggctgacatccagagttatatcctgatgttcgcctaaattcgtcataccgtgctcttccagtttcgccagcagggcagggatggagctgccgtccagaccgtagccggacaggcgcgtcggcacgcccatttgctcgaagaaatcgcgggtggccgcgatagccgcatcgatacgctcgtcgtcagaaccttcagtgatgttccacacgcgctcggcgtactgcaacagcttgccgcgtttggcgtcgcgtttctcattccacagcgcaggcagcaccaccgccagcgtctgggcgtgatccagaccgtgcatcgccgtcagttcgtggccgagcatatgcgtcgcccagtcctgcggcacgcccgctccaatcaggccgttcagcgcctgggtcgctgcccacatcacgtttgcgcgtacgttatagttctccggatcggtcagcgctttcgggccgtcttcaatcagggtcagcagaatgccttctgcaaaacgatcctgaattttggcatccaccgggtaagtgacgtactgctcaacggtgtgcacaaaggcgtccaccacgccgttcgccacctggcgcggcggcagggtgtaggtgtaaaccggatccagtaccgcgaagaccggctgcacgaacggcgaatggaacgcctgtttatcaccggtggctttacgggagatcaccgcgcctttgttggactcagaaccggtggcgggcagcgtcagcacggaccccatcgggatggcgcttttgatttcgctgccagaggtttgcaggatctgccacggatcgatgccttccgggtagtgggccgccgcggcgataaatttggtgccgtccagcaccgagccgccgccgaccgccagcaggaaggtcacgttttccttacgcgcaatctcaacggctttcatcagggtttcataagacgggttcggctcgatgccgccaaactccagcacgtcgaggccattgagggcgctgtaaacctgatccagtacgccggtttttttgacgctgccgccgccgtaagtgatcagcacgcgtgcgcctgccgggatttgatcgcgcagatcggcaatggcgtttttaccaaacagaatgcgggtgggggtatgcagattaaagttattcattgctcgtgcccttatgtgggttaaaaaaccgctgaccatggatggcctgatgcgtctcattgtggtcatcggggctgttcctctcaatgcacattcctgccgatgtcttgcccatttctccatgccgctggagaatatgcacagaaatacgcacactgtattcgtcaaaaaacccatccggagtggcgtgaaatgaaccgcgaagaaatatgtctgcacctgacagaacaggttaagcgactgaaaattcatgagaacaggctgagcgacctgttgccggatatccgcctgctgtacggcacacagccgggcacgcgcacgccggtgatgtaccagccgggcatagtgatcctcttttccgggcataaaacgggctatatcaacgaccgtgtatttcactatgacgccaatgaatatttgctgctcaccgtgccgctgccgttcgagtgtgaaaccttcgccaccccggaagtgccgctggcggggatccgcgtcaatgtggatattcttcagcttcaggaactgctgatggatatcggcgaggacgagcatttccggccagcgctggcggcaagcggcattaactccgccacgctgtccgatgaaattctctgcgcggtggagcgcctgcttgacgtgatggagcgcccgctggatgcgcgtatcctcggcaggcaaatcgtgcgggaaattctctatcatgtgctgaccggcccgcgcggcggcgcgctgctggcgctggtaagccgtcagacgcacttcagcctgatcagccgcgtattaaaacgcatcgaaagccagtacacggaaaacctgagcgttgaccagctggcggccgaagccaacatgagcgtctcggcgttccatcacaattttaaagccgtcaccagcacctcgccgttgcagtatctgaaaagctaccgtctgcaccgggcgcgcatgttaatgattcacgacggtatgaaagccagcgcggcggccatgcgggtgggatatgaaagcgcctcgcagttcagccgcgagtttaaacgctattttggcgtgacgccgggagaggatgcggccaggatcaggatgatgcaggggacgtaacaaccccctcaccgcgaggtgaggggataaaagtcaggcgttgcagtatttctttttgatcaccacgatcactgtgcccagtaacccggcgaccagcaggaatacgggcaggatcatcaggaaggtcatcacctgatcttcatggcgcttcacgaaagggatcatgctcagcgcatagcccagcgaagtcaccgcgcccacccacagcagcgcgctcagccagttaaagaactgaaagcggcggttggagaggccggagatacccgccatcgttggcagcagcgtacgcacgaaggccagaaaacgcccggccagcagcgccagcaggccatgccgctcgaacatgcaggtggcccgctggtggtatttagccggcaactgcgccagccagcttttcaccacccgcgtattgcccagccagcggccctgaatatagctcagccagcagcccagactggcggcggtggtgaggatcaccagcgccggtataaagtccatcacgccgcgggcgatcagcgctccggttaagagaagcagactgtcgcctggcaggaaagaggccggaagtaatccgttttccagaaacagcgtcgcaaacatcacgaagtaaacgacaccgacaacatgtggatcagctaacgccgcgaaatcatgatgccagagcgcggcgataatatcttgaataactaccatggactttcctgtggaaccgcatatagagcgctattgtacgcctgaactgtcaaggacaccttgatcccccacgcaagaaatgcagacgattctgctggtctggaaagatttcttgtcaggctgctaactttacacgatgcgctcaaatcccgctgctaaatcagcacgtaaatcatcaacgttttctaaacctatatgcagacggataagtgtgccagtaaagtcgacctcggcgcccggacggatcgccgcaatatgctccggctggttcgccaggatcagcgattcatagccgccccaggagtaggccatgctgaacagcgtgaagtgatcgagataagccgccagctcctgattattcagccttttacgcagcacaaatgagaacaggccgctgctgccggtaaaatcgcgcttccagaattcatgtcctttactgcccggcagcgcagggtgattcacgcaagccacctgcggatgcgccgccagccattcggcgagttgcaggctgctttcatgatgctggcgcagacgcacgctcagggtgcgcaggccgcggctggtcatataggcggtgtcagcgtccaccatttgccccatcaggtaggcgttctcgcgcagttgctcccagcagcgggcattcgccaccgccgtgccgatcatgccgtcggagtggccaatcaggtatttggtggccgcctgaatggaaatatcaatgccgaaatccagcgctttaaacaggatgcccgccgcccaggtgttgtcgatcatgatgatcgcctccggggccacgcgccgcaccgcagcaacaatcgccggcacgtcgtgcacttccatggtgatcgagccgggggattcaaggaaaacgatgcgggtattgggttggatgagtccggcaatgtcgccgccgatcagcgggtcgaaccacccggtggtaacgcccattttcgccaggatttttgtgcagaaatcctgcgtaggttcgtaggcggtgtgggtcaccagaatatgatcgccctgttcaacaaacgccagaatggtattcgccacggcagccgcgccgcaggggaagagcgcgcagcccgcgccgccttccagttcgcacatcgcttcctgtaaggagaaatgcgtcagggtgccgcgacggccataaaacagctcgccgctggcgcgccctcgcgtggcctgcttttttgcttccaccgtgtcgaacaccagagaagaggcgcgctggataacgctgttcaccgcaccctgagtatattttttgctgcgcccggcattcaccagcgcggtatcaatgtgcttcgctgccataatcgaaacctgtttttatacgtctggatgtccagactaccatgaatgcccgattctgcatcctgagggttattcattcagcacaatattttctgaaaatggcccgatgaaaggttttactgagtaagcgcaatgaaaatgcacaggaataggggcatcatgtaaatactaatgagaactactatcaattcgacgctgttttgatattattatgctcagaatttgtgatttatgtccggagatacacagtgggtaataatttgatgcagacggatctctccgtctggggtatgtatcatcatgccgatattgttgtaaaaatcgtgatgattggcctgatcctggcgtcagtagtcacctgggcaattttcttcagcaaaagcgttgagctgatctcgcaaaagcgccgccttaagcgcgaacagcaactgctcggcgaagcccgttcgctggatcaggcgagtgaaatcgccgcctcctttaagtctaaaagcctcagtacgctgttaattaacgaagcgcagaacgagcttgagctctctgccggttcggaagataacgaaggcattaaagagcgtaccggtttccgccttgagcgccgcgtggcggctgtgggccgtcatatgggccgtgggaatggctatctggcgaccattggcgcgatctcgccctttatcggcctgttcggtaccgtatggggcatcatgaacagctttatcggtatcgcccagacgcagaccactaacctggcggttgtcgcgcctggtatcgcggaagcgctgttagccacggccattggtctggttgccgccattccggcggtggtgatctacaacattttcgcccgcatgatcggcagctataaagcctcgcttggcgatgtcgccgcgcaggtgctgttactgcaaagccgcgatcttgatcttgccgccagcccgacggctaaaccggtgcacgctgcacagaaattacgtttaggttaatgtcctatggcaatgcgtcttaatgaaaatctggacgataacggcgaaatgcatgaaatcaacgtgacgccctttatcgacgtcatgctggtactgctgattatctttatggtggccgcgccgctggcgacggtggacgtgaaggtcaatctgcctgcctcgtccagccagccgcaaccgcgtccggaaaaaccggtctatctgtcggtaaaagcggataaatcgatgtttatcggcaacgatcaggtgacggaagaaaccatgatcaacgcgctgaacgccgtgaccgcgggtaaaaaagacaccacggttttcttccgcgcggataaaaccgtggattatgaaaccatgatgaaagtgatggatacgctgcatcaggcgggttatctgaagataggtctggtgggtgaagaggtcgcgaaagcgcagtaatcgccttatcacgcccggcggcgctgcgcttgccgggcctactggatctggtaggccgggtaaggcgaagccgccacccggcaaatcaaagtgtaggccgggtgaggcgaagccgcccagagtgtaggccgggtaagcgaagcgccacccggcaaaagaacgctgactccggtcagcttttttttgcgcgttattccgcaaccggcggcgttttctctgtcagcgcgacgctggtgacgtttgacgtcagatagccgccatcagccagcttgcgggtaatacgcagcgtagccgtctcacgcgccagcagatgctggtagttggcttcgaggcgggacatgattttttcgtacagttcggggtggcgcttcgccacttcgttgatcgcggcgccgtaaatctcttctttgatctgtaacgcgtaaatttcgcggcggttctgccattttaagcgcaccagcgcggcaggaatggagatcagatcccgcgccagacgggtaatatgatcatttttactctgtaccagggcatcgagattttgctttaagataaattcgtcgcttttatgattatctaaagctaaataaacgttattatcttcaacatctttcacgttattcatcctctagtttataaaacaaaggcgcatctttttcgcgggtaatgaggttaagccagacatcattaccggcggcatttatctcttcggttttttcggcaattatttgacttaaggtttgggcatcaatgtccccttcggcttgtaaatcgttaagcagacgggtaaatgtttcaatttttactacgcggtataatcgatcttttatatggcggtcgcgttcttccagcagcatatttctcgattgcctggtatggctgacattcgttaatatatcgctttcgaaatcagagagcgttctttttccctgagtgaaattaacgtctttttctgcttcccccgattcagtttccttcgcggaaatgtgaaaacgagccgggacaaggttctcgggcagcatctctaatatcctttgatttcaaacgagtggggaaggggtccgggcgtgaggttcgttgacaatatcatggcagacttttaaaatcaaaaaaaatggagccagcccatgaacagtattttttattctgttattgctttgttgttacttactgcgggcgtactttttatgatgcgcgagctgaataaaggcacgccagccgcagacagcaacccacttcccgaggccgcgccgttgtcaaaggaggagggagaagatcacttttcaatgttaatgaatgccattacgccggtgtggtactggcgtgtcaatcatgaatatattgattttctgcacgcgacaattaaaagaatgaacatatcgcaaataaatagcgtgccgggcttatttgaagcgcaacgtcgttgcagcgatctgaattcagcagtgtataagtattacgataatataaaaaaacgctgccttaacggtgagaaagttccgcactccgatctggaattactgaacttaagtcagtgttttcacgaattcagtctcgacgcctatccggaactggtcacgctggtgtggccggagtatgcccgcccggacgtggatccgcgggatgtgcgcaccgcgcaaatttgatggctgaacatgccgggtgggtgtccccggcatggtgagattatttgtccgacgacgcctgccagagattcagctcgccatctgccacatgtttatcgatctgcgccagctcttccgcgctgaaggtcagattgtccagcgcccgcacgttttcttcaatttgctccggacggcttgcgccaatcagcaccgaggtaacgcgcgcatctttcagcaaccagcttaacgccatctgcgccatcgattgtccgcgctgttgcgccatctcgttgagcaggcgcaggctgttcaggttactgtcggtcagcatcttctcggttaatccgcgcacctttttcccttcccgctgcatacgcgagccgtcaggaatgccgttgaggtattttccggtcagcagaccctgcgccagcggcgtaaaggcgatacagcccacgccgttgcgctccagcgtatccagcaggccgcttttatccacccagcggttgagcaaattgtacgagggctggtggatgagcagcgggattttccattcacgcagcaaatcgaccatcgtctgtgtgcgttcagaggagtaggacgagatacccacatacagcgctttaccgctctgcaccgcctgcgccagcgccgaggctgtctcttccatcggcgtattttcatcaacgcggtgggaatagaaaatatcgatatactccagccccatgcggctgaggctctgatcgaggctggcgagcagatacttgcgcgagccgccggagccatacgggcctggccacatgtcatagcccgctttggtagagatgatcagctcatcgcggtaggccgcaaaatcctctctcagcagacgaccaaaattttcctcggcgctgcccggcggcggaccatagttgttggccagatcgaaatgggtgatgcccgcatcaaaggcggtgcgtagcagggcgcgctgggtatccagcggctgaacgtgaccaaaactgtgccacaaacccagcgacagagcaggcaggcgtaacccgcttttcccgcagtagcgatactgcatctgctcgtaacgggcaggattggctaaccagggcatgatgtctccttttttgattataaatattcgaaacgctgtttctattttagcgttaccgccgatcgccacaagccgcagcggtcacaaatctttatgattatgtagcgttgcttaactattcattaatgcgccttatggtttaagccctcaggcgtcacgcggcccggataccaggctggaaggcaggcgcggtgagcgcttgcgggtttggctcctcaaaaaaagcgcatctttattacgggtaacatatgcataatatggcgaaacacgtaattaactatacgtgccatatttaagattacttaatttaaattaatgcaccctttttaaattaccgtctatattgagatgctgcgactacagatagtaaatagtattatttaaataagggatttattcccccataaacattgtttaaaccaacccgagaatctattagttttgggaggattcttatttttcgcatcaataagaatgttagcaggctaaataaatggagtggggattttctctttaagataagtagcttacagatagtttccgctgtaactatctgctgaactttatgtaaaagtgtgagcaaaagtgaatggcgatattatttaaatgcctggagccttgttttttaaaggattcctggtggattattttttgatcaaaaaaggtccgccgtggcatacatattacgcatattttgccgataaccataataagtcccaccttctggatgggaatgcacctcaagcaaggaattaactatgtgtatgctccaaaacttcacaattcgctttgtgatgctcgccattcttggcgttttctgcctgctgtggtcaggtgtcggattatttagcgtgttatcgctgtcgaaagtggctgaaggtaatgatatggatcgccagctggtcacgcagatgacgctgctcagccagggcaacgatcagtatttccgcgtcgtcacccgattgtcacgggcaatggaggcaaaagcgacgggcggcagcgccgattttggtccggttcagcaggcgctggacaatatgaaaaccaaactggatgcgctgaaggcgatctcacccggcccgattgatgcgactgtttccgcacaggtgatcggtaactggcaggcgctgctggatcagggcgtgacggcgcaggttcagtttgcgcagcaaggcaatcttgacgcttaccgtaatcaggcaagcaatgtgacgcctgccctcagccgcgcctttggtgccagcaccgaagcgttcaacaaagcggcgaaccagatgctggatgatacccgcgtcatggtggatcatcagaccagtgttacccgcacggcgatcatcactgccgtgatatttggccttctgttactgctgttctccgatcgctatctggttgccatgctggttaaaccgctggcgaaaattcgccagcacttcagcctgatcgcccggggcgatctcagccagccggtagaggcgatgggccgtaactgtgtgggccagatggtgccgctgttgcaggaaatgcaggatagcctgcgcgatgcggtcagctccattcgttccggcagcgacaatatctggcgcggtgcaacggaaatttccagcggcaataacgatctctcatcccgtacggaagagcaggcggcagcgctggaagagacagcggccagcatggaacaactgaccgccaccgtgaagctgaacgcagacaacgcacgtcaggccagcgaactggcggaagtggcgtccaccactgccagcaaaggcggcgcgctggtcagcgaagtggtcaccaccatgagcgacatttcagacagctcgaagaaaatcgccgagatcaccacggtgatcaacagtatcgccttccagaccaatatcctggcgctgaacgccgccgttgaagcggcgcgtgccggtgaacagggccgtggtttcgcggtggtggcgggtgaagtgcgtaatctggccagccgcagcgcaggggcggccaaagagatcgaaaccctgattgcggactcggtcagccgcgtcgataaaggcgcaaaactggtgaacgataccggcaccaccatggaaggcattctgcgtgcggttactgaagtgaccactattatgaagcagatcgccggcgcgtccgcggagcagagcaaaggcatttcgcaggtcggggtggccatcacccagatggacagcgtcacccagcagaacgccgcgctggtggagcaggtttcggccgccgccgtggcgctggagcgtcagacggaggagatgcagcgtgcggttcagcagttccgtttatcggcagacgagcaaaagcttgccgccgcgcctgcggcgacatcgtcgtcacgccataccccgccagtaaaatcacccgtctctgacgagtgggtcgcgttttaacttttagtattctgatcaccaggccacgacggtaacgttgtggctttttttgtaaataaccatgtcacttttaaggttaattgtcgggccgatcgcagcaattttcccgggaaggggttgaaatagcgccacctttgcataaggaagcgcaattatggttacaaaaacatctgctattccgcccggcatcacgcgccgggatttcatgacgttatgcgctgccctggccgccaccatggggcttagcagccaggcggccgcccgcatggccggggcgctcagccagccgcagcgcctgccggttatctggatcggcgcgcaggaatgtaccggctgtaccgaatcgctgctgcgcgccacccatcccaccattgaaaatctgctgctggaaaccctttccctcgaatatcacgaagtgctgagcgcggcctttgggcatcaggccgaagacaacaaacatcaggcgctggaaaaatatcaggggcagtacgtgctggtggtggatggctcggtgccgctgaaggacaacggcatttactgcatggtcgccggtgagcccattgtcgaccatatccgtaaagccgctgaacatgcggcggccattatcgccattggctcctgtgccgcctggggcggcgtggcggcggcaggcgtcaatccaaccggcgccgtcggattgcaggcggcactgccaggcaaaacggtgatcaatattcccggctgcccgccgaatccgcataactttcttgccaccgtggcgcacatcattacctggggcaagccgcccgcgctggatgccaaaaaccgcccgacctttgcttatggtcgattgatccatgaacactgcgaacggcgaccgcacttcgacgccggacgcttcgcccgcgcctttggcgacgagggccatcgcgccggctggtgtttatatcatttaggctgcaaaggcccggaaacctggggcaactgttcgacgctgcaattctgcgatgtcggtggcgtgtggccggtggcgattggtcatccgtgctacggctgtaacgaagaaggcatcggcttttataaaggcattcaccagctcgccagcgtggaaaatccgacgccgcgcgccgacaaaccggaggtggcgcaaaaagagggcggtgcggtttccgccacggcgatggggttactcggcggcgtcattggcgtggtgggtggcgtcagcctgatgacggtgcgcgaactggggcgtcagcaaaagcacgatgacgccgatcgtcagggagagtgatcgtggacagacgtgatttcctcaaactctctgccgggagcgccttgctgtcaggcagcgcgtcttccgctttcgccgccgccagcaaccgtccgccgatccccggcgcgctggggatgctgtacgactccacgctttgcatcggctgccaggcctgcgtcacccgctgccaggatcttaactttccagcccgcaatccgcagggggaagccacctggtcgaacaatgacaaactttccccctacaccaacaacatcattcaggtgtggcgcagcggcagcgggcggcacaaagaccaggtgaaagatggttacgcctacatcaaaaagcagtgcatgcattgtgttgatcctaactgcgtgtcggtctgcccggtatcggcgctgaaaaaagatcctcttaccggcattgtgcattacgacgccagcgtctgtaccggctgccgctactgcatggtcggctgcccgtttaacgtgccgaaatatgattacgctaacccgttcggggcgctgcataagtgtgagctgtgtaatcagccggggctggcgcggcttgataacggcggtctgcccggctgcgtggaggcctgtccggcgggagcggtcattttcggcacccgcgacgcgctgctggcggaagcgaaaaagcggctggcgctgacgcccggcagccagtaccgctatccgcgccagacgctcagtacgggggatacttatctgcatccggtggcgcgttatgtgccgcatatctatggcgaaagggaggcgggcggcacccaggtgctggtgctgagcgccgtgccgatggaaaacctcgatctgccgccgctggatgagctctctaccggcgcacgtgccgaaaatattcagcatacggtttacaaaggcatgctgctgccgctggcgatgctggcgggcctgaccgtgctggtgcgtcgtcacagtaaaggcgatcagcataaggaggacgatgatgacgcatcatgatccgcagccgctgggcggaaaactcatcaataaggcgatcctgatcttcgcgccgctggtggtgctgtgcctgatccttatcggcaaacggctggtgttcggtctcggatcggtttccgatcttaacggcggctacccctgggggatctggatcgccttcgatctgttaatcggcaccggtttcgcctgcggcggctgggcgctggcgtgggcggtgtacgtttttaaccgcggcgaatatcacccgctggtgcgcccggcgctgctggccagcctgttcggttactccctgggcgggctgtcgatcaccattgacgtcgggcgttactggaacctgccctatttctatctgccagggcatttcaacgtcaactcggtgctgtttgaaaccgccgtctgtatgacgatctacatcggcgtgatggcgctggaattcgcgcccgcagtgctggagcgcctcggctggaaagtgtcgctcaggcgcatcaacaaagtgatgttttttattatcgcgctgggggcgctgctgcccaccatgcaccagtcgtcgatgggatcgttaatgatcgttgccgggcacaaagtgcatccgttgtggcagagctatgaaatgctgccgctgttttccctgctcaccgcctttatcatgggcttctccattgtgattttcgaaggatcgctggtgcagagcgcgctgcgcggcaggggcgcggatgaaaagccgctgtttatcaaactgaccgggctgttaagccttctgctggcgctgttcctgctgctgcgttttggcgaactgctctggcgcgacaagttgcactacgtctttgccggagacgtttactctgcactgttctgggttgaaaccgcgctgctggcgtttccgctgctggtgctgcgggtaacccgctggcggcgcgacagccgggtactttttctggcggcgctcagccagctgctcggctgcgcctgctggcggctctcttattcgctgctggcctttaaccccggcggcggctggcgctattttccgacctgggaagagctgctgatctccatcggctttgtggccattgagatctgcgcctacatcttactggtccgcctgctgccgatcattcctccgctacaacagcctgttcattgtcctcagggagcgagtaaagcatgagccaacgaattactattgatcccgttacccgtattgaaggccatctgcgcattgactgcgagatcgccgacggcgtggtgtcgaaagcctgggcctccggcaccatgtggcgcggcatggaaactatcgttaaggatcgcgatccgcgcgatgcctggatgatcatgcagcgcatctgcggcgtctgcaccaccacccatgcgctcgcgtcggtgcgcgccgtcgaaagcgcgctcaagatcaacgtaccgctgaacgcgcagtacatccgcaatatcattctcgcagcgcacaccacccacgatcatatcgtccatttttatcagttgtcggcactggactgggtggatattaccgcggcgctcaatgccgatccggccaaagcggcggcgctgctggcggggatctcccgctggccgctcaacagcgcggcggaatttacccgtgtacaaaacaaagtgaaggagctggtcgccagcggacaactggggattttcgccaacggctactggggacatccggccatgaagctgccgccggaggtgaacctgatcgccgtcgcccactatttacaggcgctggagtgccagcgggatgcgaaccgtattgtggcgctactgggcggcaaatcgccccatatccagaatctggcggtgggcggcgtggcgaaccccatcaaccccgacggcattggcgtgcttaaccttgaacggctgatgtacatcaaatcctttatcgacaagctcggcgattttatcgagcaggtctataaagtcgacacggcggtgatcgccgcgtattacccggaatggctggcgcaggggcagggggcggtgaactatctctgcgcgccggaatacccaaccgacagccagaacggcagctttttgttccccggcggggccattaccgatggcgatctcgctaccttccgcccgattaacgcccacagcagccagtggctgatcaacggcattcaggagagcgcgaaacatgcctggtaccaggacgacgaaccccaggctccctggcagggcaccacaaatccggctcacaccggctgggcggatgacggcaaatattcctgggtgaaatccccgaccttttacggcaaaaccgtggaagtcgggccgctggcgacgctgctgtgcaagctggcggcggggcggcaggagacccaaacgaaattgcaggaaattaacgacatttaccagcagctcaccggtcaacgcattgaggtggcacaactgcattctacgctgggacgcattatcggccggacggttcacgcctgcgaactgcagctgatcctgcaacatcagtaccaggcgctgattgccagtatcggtaaaggcgatcacctcacctgggtgaagccagtcatccccgaaacgggggaattttacggcgtcggttttctcgaagcgccgcgcggcatgttatctcactggatggtgatcaaggacggcaaaatcgctaactatcaggcggtggtgccgtccacctggaacgccgggccgcgcaacttcaacgatcagccggggccttatgaacaggcgctggtgggcacgcgcattgccgatccgcataagccgctggaagtggtgcgcaccattcactctttcgatccgtgtatgtcctgtgccgtgcatctggtggatacggacggcggcgatccggtatcggtaaaggtgctgtgatgaccattttagtgttaggcgtgggcaatattttgctcagcgacgaagccattggcgtgcgcatcgccgggacgctggcggcgcgttaccatctgccggagcacgtggaagtgcttgatggcggcacggcgggcatggagctgctggaggcgatggcgaatcgccgccatctgattattgtcgacgccattgtctcgcgtaaatactcccccggcaccgttctgacgctgcgcgacgacgaggtgccggtgctgttcaccaacaaaatttcgccccatcagctgggactggcggacgtgttatcggcgctgcgttttaccggcgagtttccgcgcaagctgacgcttatcggcgtcattcccgcatcgctggaaccgcacgtcggcttaacgccggtggtggccgccagtctggagcctgcgctggcgcgggtgatcgctgaactgcgtgacagcggggtgacgctggtggagcgtgcggcatgagcggcttttccggtgatccggcggagcaggtgcagacggcctttgcggcgatcggcgcacgcacgctgcacgatctggcgtttttgcatccggcaatgccggtatatgccgcgccctttaccctgtttgaagagcagtggatcggctgtctcatcacgccgtggatgctcagcgcgctggtgctgcccggcccgcatcagcgctggcagccgcgtccggtagggggaaaactcgccctcgcgctgcctgcgggaaacatcacctttaccgtcggcgagctggaaagcatcgggcactatctggcctgttcgctgatgtcgccggtgcagcgcgggctgacggcggcgcagggcataaatctgacgaacgactgcgcccgtatgctgctctcgctgccggtaaacaccccggatctgtcgcgccggcgggcgctgtttggctggcaggcgcgcgcccgtgcatgagctgtcgctgtgccagagcgtggtggaaattgtgctggaacaggcggcgcaggccggcgcccggcgcgtaacaggcgtctggctggaaattggcgcgctggcctgcgtggaagaaaacgcgctgcgctttagctttgccagcgtctgcgcgcagacggcggcgcagggctgcgcgttacatctcatccatcgcccggcgcaggcgtggtgctggacgtgcagcgcccgcgtggaagtgcagcgtcacgacgcggtctgtccgtgctgtcatggcgcgagccttagcgtggaaggcggcgaggcgctgcgggtgaaaagtatcgaaatcgaataaaaggaataaccgatgtgtataggcgtgccggggcagatcgttgcggttggggaggatcttcaccagctggcgacggtaaacatctgcggcgtacaacgacagattaacatcgcgctggtgtgcgaaggcgatcccgccgcgctgttggggaagtgggtgctggtgcacgtcggttttgcgatgagcatcattgatgaacagcaggcgagagaaaccctggcggcgttagagcagctggacagttaacggcggacgtcggtgatcatctgcgtcaccgcgctcaggttgccaatttttacatcgctggcgcgctgaaatttgcttttatcaatcagcaataacgactgctgcgcccggcttagcaactgcgttttgaatccggcattatgtaccgtcggatcccacatatcgccgtgggtatcaacaccctcgcaggaaaagataaacaggtcgatctcaagcgctttcagtaagggcgcgagcgtcggattcatgtagcagcggtatttacgatccagttcgccgccggtgcaaatcagcctgacgtgctggcggcgcgccatctcctgacaaacgggctggctgttggtaaatacggtcagcggcacgtccggcagctgtcgtgccagatgaaaacaggtggagctggcatccagcgccaggcacatcccttcctcgatccacgccagcgcatggcgggcaatatccgctttatccgcgtaatggctttttaaccgggcgacgaagggctcgccgccatcgtgattttgcgtgtggatcagccgcgcgcgcccgtgatgacgcacaattttcccctgcgcctgtaacgccgtgagatcccggcgcagcgtctctttgctgatgccgagctgtgccgccaggctggcggtggtcagggtgtcgtggcgggcgaggagcgccagaagggtttgttgtcgcgtggatttcatgcccggcctcaggctgtcagccgcggggagatggagatcagcgttgcgcccatcgccacgccgtttttgccgctgtgcttgatgtgatacatcgcctcgtccgcgcgggttaaggcttccacaaagctgtcctgcggctgcacttcatcaatgccaatggatgcgcccaccgatccgacgccgttatccagatcaaagggcgtcagcacggcgtgcagcagatcctgcgccgcgcggtggatcgtcgcatccgccagcgcaaagggcagcaacagcacgaactcatcgccgccgagccgcccgatagtggtgcccggcggacaggtgtcgcgcagacgctggctgagctggatcagcaatacatcgccgctacgatgcccgagggtatcgttaacatgcttaaaattatccagatcgataaaagccacgcacagcggcccggcctgtttacgctcgtcgaactgtttgatcagcgcgtgacggttggcaagtccggtgagcggatcgtgattggccagcagcgccagttgctcttcgtactgcttctctttggtcatgtcgatgtgtgtgccggtgaccttcagcggattgccgctggcatcccgctcgctgacgcgcccgcgatccagcacccaggtgatggtgccgtttttatgctgcatgcggtgcagggcttcgtagtaaggggctttgccctcaagatgatcgtaaaacgccttcagtacccagggacgatcctccggatgcagatgatctttccatacctcaaactgcgcgctgagctctttcggctgatagccgagcatcgatccccagcggcggttgaagatgatcagtttcccgctgggcacatccagctgccacaggcacaggccggtgccgtcgagggtagcgctgagtttactgcgggcgtcacgcgccagcctcaccagacgggcattatgctttttcagattctggatctgctgtgtcagggcgcgttcagacataggtgtccgcaatgaatgaaaaaaaatcattcttaccagttattattttgttgtaaatatgcggcgagaaaaagaaaccggcgggcggcagagaaaagaaaaaccgggcgtagttcgcccggttacacaggttagctgctgcgcttgtcttcggtgttggtatcgaagtcgctagcgtcgtgacgctcgtgcagctgttcgttcagcggcccgttggtgcggttgacgatgcggccacgcttcacggcggggcgcaccgccacctctttcgcccaacgtagtacgtttttgtagctgccggcatcgaggaactcggcggcgtcatagatggtgccgagcaccacgttgccgtaccacggccagatcgccatatccgcgatggtgtattcgtcaccggccacaaacttatgcttcgccagctgctgatccagcacgtcgagctgacgcttggcttccatggtaaagcggttgatggcgtactcgattttcaccggcgcatagtgataaaaatgcccgaatccgccgccgaggaacggggctgcgccctgtagccagaacagccagttcagcgcttcggtacgcccggccggatccttcggcaggaagtggccgtatttttctgccagatacagcaggatagatccggattcgaacacgcgggtcggcggagtagtggagtgatcgctcagcgccgggattttagagttcgggtttacctcaacaaagccgctggagaactgatcgccttcgccaatacggataagccaggcatcgtattccgcggcggtcacgcctttttccagcagctcttccagcagaattgtcaccttctggccgttaggcgtaccgagggagtagagctgaagtgggtgcttgccaactggcagggttttttcatgcgtggcgccggataccgggcgattgatgctggcaaaggcgccgcctgcggatttatcccacgtccaggttttcggtggctgatactgattgtctgacatgttaacctgccttttcattgatgtgttgaagcagtgtagcaggcgctacgcgcagaaacggacggttagtgcgcttaacgccaggtcgttgttattcaggaaaaaaggcgttcagcccagacggtgacgtcatctccgctgcccagatccggctgcaccagaccgttgaccataaaggtcggtgagacgtgaatgccgttctgacgggcatatttgcagtgccatttaatgacggtttgcagatccgcccggccaaagggtaccgaggcatccaccccgctgtaagctttaaggcgcgccagaatatcgtttggcgtggcgtccatattcggaccgctgcaatgatcggtaaattcaaactcttcacggtgatcggccaccgcctgcatgactttatgcgccgcgtcgcgcccgtccggcagcgtcgaggccgcaaggatatagcgcacgatcacgccggaatacagatgccacggttgggattgcagacggattttaatggtgacgttatcttcgccgacatgctgtaacagcgcgtccagcttgttaaaggctttgacggagaacggacaggtaggctcaagaaaaacttcaaaggtgcgtggcccgtggccccactccagcggttgcgcgttaagggcagcttgctgactcatgttaactcctgatgttgtgtgtgtttattcactatatcaaaagcgtgatgaatgtttttagcatggcgggcagagaaaggaaaaggcacgctggcgtgcctttttaatctttatgggcaggtccttgacgtaacatcaaaccttaagcattttcaccgtcgcatccacgtcgatctcatcttccgtaaagattaacgtctctccctggaaggtggtgatcgccagttttttcagcgtccgcatttgtcccggcttgatatcggtttttgggcgaatgttgcccatcagcagccctacggacagcacggtattttctttatcgatgcgcgcctcgacggggacttcttcgctgaaaaccacgtaagatttgatggccgtaagcttaatgcgctcaccggcgataaagatgtatttgctttccggcagcactttcactgcgtaggcggacaggcctttattattggtggtgggttcaaaggtcaccgccgcatctttcttgatgagttcagggttggcgaccttaatcacatgaaaataacggttatccccgttttcatctttgagaaatccaaaacctttgtctttgaaccaggttgtgattgttccgttcatcgccattaccgcctgtttaatcgtttatctgctcagttcttgccgcgcgcagtgtaatgcacaacgcctgcgcgtactacgttttgcttaccacatcaaatcatcaggtactttgaaatctgcatacggatcgtcttcatcctgcgcttcctgactcaacgcactgttgaggacaatactttctgcatcccgctgcgcaattttatcggcaacgcttgccggaataatggcgtattcactctcgccgctgctgtctttcatcagacgcgcaatagcaagacgtccgctaatcaactgcgcctgggtcaccttatcgacggcgatttttttaataaagttattgtcggtaaagttgaaatcaatattgcctctggcaatgttgatgcggttcatctcaatcagctgcttcacctgcgctttgtactctttggacaacgctgcttgtttttgctgttcgctcagcagcttgtcgcgctccagctgtgcctttttattctcttccaccgcagcacgggcttcacgcgtctgcacgcgggatttcttcgccgtgcgctgcactttggccatttttttgctggtcaccaggcccgctttcagcatctgctcttgtaaggtaagtttggtcatcgtcgtttctgaactcattggataatttttgtcattatacccgcaattgctgaggctgtgacaggtaccgatggaggcgggggagtaggagcgcagcgggcagaacgtccaaaagcaaaaacccgccttgtgggcgggttctttaaatagtggtgcccggactcggaatcgaaccaaggacacggggattttcaatcccctgctctaccgactgagctatccgggcaacggggcgcattaaacctgatccgcctcgtgtcgtcaacgaaatttatttaaatcgttgcagactgcacaatctatcagcaatctggcgtcactgcacgcggttcaggcgaaaaaagcgctccaggcggcggagatcggcatggcgataatcaacgcgggcagcatgttagcgacggcaaacatcttgataccgcagatacgcaggccggtggccagcagcagaataccgccgacggcagtgaaatcgcccatcatcgccggtgtggtgagcggcagaataaaggtcgcgcaggtggcgagggtaagctgaataatcagcatcggcaccgaaatggccgccacggcaatgcccagcgaggtggcaaaaatcaccgcggtaaagaagtcgagaaaggctttggcgatcaaaatactcggatcgccggtcatgccttcgcgcatcgcgccgaaaatcccggtgccgctggcgcagaacagaataatgatggcgaccagactttcgataaaagcgtcatgaccttccggcacgccggttgattttttgccgcgctgcaccagtttacgcaggcggttcaccccgccgctgatgccgcgctcgacgtaacagatctcgccaatcagcgtgcccaccagggttgccagcaccatcaccggcaggttgacgcatttcattaccagaagaatgccgatacccagcgagcacaggccgaaaatggcgggcatcgaaccacgcacgcgttcgggtaagcggtggcttaacaccgcgccgagggtgccgccgattagcacggcagcggcattgataaaggggccagttaacacgctgttactcctgaacaatttgtttgcactattgcatagtatgccgcaaaaactcaggttccaggcattttttgcgtgttgcacctgccggtcaaaagtgacattattgcgcgaaatttcctctcttaatcacggggccgcctggatgacaccacattctgctcgccagacctgtcgcataattatgcgatcgcgtacccgttctgccatgatccatactcttctcaccatgcggtgagggcaacgcaggctcatccgagggcaaccgtaaaggcagacgcgatctgtttttactgatgtctggcgattggagctggctccagtcagataccttcattgggtgagatcgccatctcgcccggggctttttactcccctgaaacgggtaaacgtgcttatgaaaaccatgaaaattgccgccagccgcgagctggtttcccagctttccacccatcgcgaggtggtcagcctggacaacacggattttaccgacgtggcggcagtcgtcattacggtggctgacagttacagcggcattctcgcgctcttaaaacgtacaggctttaagctgccggtattcctgttcagcgacacgcctgccgatgcgccagcgggcgtcgaggcggtgatcggcggtaaagcgcaggagatgctggagctggaatccgcggcctgccgttacgaagaaaacctgctgccgccgtttttcgataccctgacgcagtatgtggcgatgaacaacagcacttttgcctgtccgggacatcagcacggcgcgttcttcaaaaaacaccctgccggacgtcagttttttgacttcttcggcgagaacgtttttcgcgctgacatgtgcaatgccgacgttaagctcggcgatctgctgatccatgaaggttccgccaaacacgcgcagaaatttgccgccaaagtgttccatgcggataaaacctactttgtgctgaacggcacgtcggcggcgaacaaagttgtcaccaatgcgctgctgacgcgcggcgatctggtgctctttgaccgtaacaaccataaatccaaccaccatggcgcgctgatccaggcgggggcgaccccggtctatctggaagcggcgcgtaacccgtttggctttatcggcggcattgacgagcactgtttcgacgagcgttacctgcgcgagcagatccgcgccgtcgcgccgcagaaagcggacgatgcgcgcccgttccgcctggcggtgatccagcttggcacctacgacggcaccatctacaacgcccgtcaggtgatcgacaagatcggatcgctgtgcgattacatcctttttgactcggcgtgggtgggctacgagcagtttattccgatgatggccgactgctcgccgctgctgctggatctgaatgaaaacgatccggggatcttcgtcacccagtcggtgcacaagcagcaggcgggcttctcccagacctcgcagattcacaaaaaagataaccacattcgcggccaggcgcgcttctgcccgcataaacggctgaacaacgcctttatgctgcacgcttccaccagcccgttttatccgctgttcgccgcgctggacgtcaatgccaagatccacgaaggtgaaagcggccgccgcctgtgggcagagtgcgttgagctgggcatcgaagcgcgcaaggcgatcatcgccaactgtaagatgattaaaccttttgtgccgccggaagtggcggggcgaccgtggcaggatcacccgactcacgccatcgccagcgaacgtcgcttcttcagctttgagccgggggcgagctggcacggttttgaaggctacgcccgcgagcaatattttgtcgatccctgcaagctgctgctcaccacgccggggatcgatgcgcagaccggtgactacaccgatttcggtattccggcgaccattctggcgcactacttgcgtgagaacggcatcgtgccggagaagtgcgatctgaactcgatcctcttcctgctgacgcctgccgagagcgcggagaaaatggcgcagctggtggcgatgcttggtcagttcgagcagcacattgaagacgatacgccgctggcggacgtgctgccgaccatcttcaacaaatatccggtgcgctaccgcgattacaccctgcgcgagctgtgtcaggagatgcacgatttgtacgtcagctttgacgttaaagatctgcaaaaagcgatgttccgcgccgacagtttcccgccggtggcgatgaatccgcaggatgcgaacagcgagttcattcgcggcaatgtggagctggtgcgcatcagcgaagccgaagggcgcatcgcggcggaaggcgcgctgccgtatccgccgggcgtcttatgcgtggtaccgggggaagtgtggggcggtgcggtacagcgctatttcctcgcgctggaagagggcgtgaacctgctgccgggcttctcgccagagctacagggcgtgtatagcgaaacagacgccgatggtatcaagcgtctgtttggctatgtgttaacagagaaataaaaccggaatgccttacctgcgacgatagctcttctgcgcggtatccactttatagagatagcggcgcgattcagcggacggatgccgcgtggtgagtgcttcgtacacatcccccggcgtcatgcggttaataatgttcgccgcctgcaccttatcgctggagaacacccgcagcacgctgcccgcgccgccgttataggcggtgatcaccgcataacgccgtgaggtcgggttggtaatgccggacagataaacattgttcagcatcgccagataagccgtgccggtatcaatattactcgccggatcgaacaggaagttgcggtccggcatcccggagcgaccctgggcgcggaacacgtctttcccggcgctgtgctggacaacctgcatcagccccagcgcatcggagcggctgacggcgtacgggttaaaggaggattcggtctgcataatggccaggataagcgattcatcgacgccatacttgcgtgacgcctgacgcaccatgccggtgtatttatgggcgcgtttatccaggtggttcgccaccagattaatggtcacgctgtagatcactttcagcccgttctgccggcttttcatgcgcgtttgcagcagataatccgcgtaacgtgccgcgcgccactgccagcgaatggcctcgccattgttatccactacctgtccgtagaggaacggctgtttggaaataggaatgtcatcgacatcggaatagaggtcgatagagccgggatcgtcacccatcaacagcgtcttgatgatcgccttgcgcaggtgcgccgcaggatctgtcccggcgatggtttcgatggtgatcgagccgtcatcaaagttgatgtggctgcgggtctggtactgatcggtgtacttaacgtagtccttggggccggcaatcaggacttcgttaaatccccagatattttcgatgttatgggcgaactgccccatcagaatgtcaaaaccgttggtgtcctttacccaggcttcgttatagctatcgcccttattgttggaactggaacacgagatgagtaacggcgcgatcagggcaaacgctaaatattttttcatcattccgcaggtgcgtgttgtgttggtgttataagtgaaaaagccgggttaccccggcaatgttattcttattcctgcggcttatagccttcgatgtgcacgtctttaccttcgaacaggaagttgatcatctcctgctccagaagtttacggtgctccaggttcatcatattgagtttcttttcgttgatgagcatggtctgcttctgctgccactgcgcccaggcttctttggaaatctcgttatagatgcgcttaccgacgtcgcccggataaagctggaaatcctgaccttccgcttcacggcccaggaaggtacaaaaaatggttctgctcataaaaattcctctttcatctcagcgctatacagcggcgccggtacgtaattgctgtaacaggcgctcaacgggcgccgccagtccgacggattgcggttgcgctaagttataccagagacccgctccttcatccatgcatgcggtgaatgaggacacgggaagccacattggcacaatatccagatggaaatggctgaaagtatggcgaaacgccgttaactggctgagagtatcggcgctaatctgacgttctgccagccagtgacgcagactgtcttcatcttcgaactgcggaaagcagaataatcccccccacaggccgaccggcggacgctgggccagaaacacctcgtcgccgtgctgaagcatcagaaaatagccggtgcgctccggcagcgtctgcttcggttttttgcccggatacagcgcccagctctcatgttgatacgcttcgcagccattattgagcggacaaagcgagcacttcggttttgaacgggtgcagaccatcgcccctaaatccatcatcgcctggttaaagcgcgccacgccctcggcgggcgtcacctgttcgctgatgtcccacaggcgtttttccacctcttttttacctggccagccgccgaccgcgtagcagcgggccagcacgcgcttcacgttgccgtcgaggatcgggaaatgtttattgagcgacagggataaaatcgccccggcggtagagcgcccgacgccgggcagcgccgccacttcctcaaaggtgtccgggaactgtccgtgatgcagcgtcgccacctgctgcgctgccttatgcagattgcgcgcgcgggcgtaatagccaaggccggtccacaggtgcagcacctcatcaaggggcgcattggctaaatccgtcaccgtcgggaagcgcgccataaagcgctcaaagtaggggatcacggtggtgacctgcgtttgttgcaacatcacctcagagagccatactttgtagggcgttttttcgagttgccagggcagagttttacgcccgtatttgtcataccactccagcacctgggctgaaaattgcgacgcgtttaaggtcaaagcagggattccgggtaacgatttggaggagccagattgcagcacagcggcacagaggtgtaaaccagaagtttccggtgcttgcatccggcaactaactttggataatgcccgtttcccgaacactctcacaagcagacatatttatgaagaacgacgtcatttcaccggaatttgatgaaaacggtcgcccgctgcgccgtattcgcagctttgtccgccgccaggggcgtctgacgaaaggtcaggagcacgcgctggaaaacttctggccggtgatgggcgtggagttcaccgaagaaccgctggatttcgctgcgctgttcggccgcgacgcgccggttacgctggagatagggttcggcatgggggcatcgctggtcactatggcgaaagcgaagccggagcagaatttcctcggcattgaagtgcattcgccgggtgtgggcgcttgtcttgccactgcccatgaagagggtgtcgagaacctgcgcgtgatgtgccacgacgcggtagaagtgctgcacaaaatgatccctgacaattctttaaccatggtacagctctttttccctgacccatggcataaagcacgtcataataaacgccgtatcgttcagccgccgtttgcggaactggtgaaaagcaaactgaagctgggcggcgtattccatatggcaaccgactgggaagcctatgcagaacacatgctggaagtgatgtcatcgctggacggctataaaaaccagtccgccagcaatgactatgtgccgcgtcctgaatcgcgtccggtaaccaaatttgaacagcgtggccatcgtcttggtcacggcgtatgggacttaatgttcgagagggtgaaataatggcaacgaaccgtagccgtcgtctgcgtaagaaaatgcatatcgacgagtttcaggaattaggcttttccgtcgcatggcgtttcccggaaggcaccagtgaagagcagattgaccagaccgtggatgacttcatcaatgaagtgatcgagccgaacaaactggcgtttgacggcagcggttatctggtgtgggaagggctgatttgcaaacaggaaatcggcaaatgcactgaagagcaccaggccattgtgcgtaaatggctcgaagatcgtaagttcgacgatgtccgcatcagcgaactttttgacgtctggtgggactaagtacataccgaaagggccggcacatgccggcccattttgtctctgaaggagtttttatgttgcgcaaaacgctgctggcggctgccctgacggtaaccgcatttaccgcacaggctgaatataaatgtagcgtcacgccgcgtgatgacgtggtggtaagcccgcaaaccgtgcaggtgaaaggcgagaacggcaatctggtgatgacgccggacggcaacgtgatgtttaacggcaagcaatacagcctgagcgccgcccagcgcgagcaggcgaaagattatcaggcggatttacgcacggcgctgccgtggatcgacgacggtgcgcgtagccgcgtcgaaaaaggccgcgtggcgcttgataacatcatcgctaaagaagtgggtgaaagcagcaatatgcgcggtcgcctcaccaaactcgacgcgcagttaaaagagcagatgaaccgcattcttgagcgtcgtcctgacggcatcaccttccattacaaagccattgatgacgtgcgtgctaacggccagcagctggttaatcaggcgatgggcggcatcctgcaggacagcatcaatgagatgggcgcgaaagccgtgctgaaaggcggcggcaatccgttgcagggcgtgctcggcagcctcggcggattacagaccgcgatccagaacgaatggaagaatcaggaagctgattttgaacagttcggcaaagccgtgtgcagccgcgtggtgtcgctggaagaaagccgcaaagcgctggtcagcgggctgaagtaaggtttttcccctcaccccagccctctcccggagggagagggagaaatcatccgccggctggtcccctctccctggggagagggtcagggtgaggggagtttcaaaaatctgccggcgctttaaacgtcatactgttgccaaaagccggatgggtgatggtcagcatttccgcatgcagttgcaggcgcggggccatcgccagcgcgtcaggtgtggcgtaaaaccgatcgcctaagatcggatgccccagcgcctgcatatgcacacgcagctggtgggaacgcccggtgatcggctttaactctacgcgcgcgctgttgtccgccgcatactccagcacacgatattccgtctgcgccggtttcccggtttcataacacactttttgcagcgggcgattcggccagtcgcaaatcagcggtaaatccaccagaccctcttcttttgccggatggccccacacgcgcgccacatactgcttcttcggctcacgctcgcggaattgccgcttaagctcgcgctcagcggctttgttcagcgccaccacaatcacgccgctggtagccatatccagacgatggacggattcagcctgcggataatcgcgctgaatacgcgtcatcacgctgtctttatgctcgtcaagacgtccgggcacggacaacaggccgctcggcttgttgaccaccataatgtgctcatcctgatacagaatgaccagccacggatcctgcggcggattgtagggttccatcaacattgcaggctccggttactgatgcgtcacgacgatcaaacgcagggcatcaagacgccagcccgcttcggccaggctctccatcacctgctggcgattgctttcaatggccgccagttcatcatcacggatgttcgggttgaccgctttcagcgcttccagacgggagagttcagcagagagcttctcatccgcttcagtacgcgcggcttcgatcagcgctttcgcggctttttcgatctgcgcttcgccctgttgcagaatggcgtgcacgtcctgctgcaccgcgttcaccagcttgctgccggtatgacggttcaccgcgctcagctgacggttaaaggtttcaaactccacctgtgccgccaggttgttgccgtttttatccagcagcatgcgcaccggggtggcaggcaggaaacggttaagctgaagctgtttcggtgcctgagcttccaccacgtagatcagctccagcagcagcgtccccaccggcagagctttgtttttcagcagcgaaatggtgctgctgccggtatcgccggagaggatcagatccagaccgttgcggatcagcgggtgctcccaggtgacaaactgcgcgtcttcacgggacagcgccacatcacgttcaaaggtgatggtgcagccatcttccggcaggccagggaaatccggcaccagcatatggtcggacggcgtcagcacgatcatgttttcgccgcgatcgtcctgattaatgccgacaatatcgaacaggttcatggcaaagctgatcagcgccgtgtcgtcgtcctgctcttcaatgctttccgccagagcctgcgctttttcgccgccgttggagtggatctccagcagacgatcgcgcccctgctcaagctgggctttcagcgcgtcgtgctgctcgcggcaggatttgatcagatcgtcaaagccgtcggtgttttccggcgctgccagatagccgataagatcggtatacaccttgtcataaatcgcgcggccggtcgggcaggtgtgttcaaaggcgtccagaccctcatggaaccagcgcaccagcacggactgggcggttttttccaggaaaggcacgtggatctgaatatcatgcgcctgaccgatacgatccagacgaccaatacgctgctccagcagatccgggttgaacggcagatcgaacatcaccaggttactggcgaactggaagttacggccttcggagccgatttccgagcacaacagcacctgcgcgccgctgtcctcttcgccgaaccatgccgctgcgcggtcgcgttcaatgatcgacatgccttcgtggaacactgccgcacgaatgccttcgcgctcgcgcagcacctgctcaagttgcagcgcggtggcggctttggcgcaaatcaccagcactttctgcgagcggtggctggtcagataacccatcagccattcgacgcgcggatcgaagttccaccaggtgccggaatcgccttcaaattcctgataaatctgctccggatagagcatgtcgcgggcgcgctcttcggcgcttttccgcgcgcccataatgccggagactttgattgccgtctgatactgcatcggcagcggcagcttaacagtatgcagctcgcgtttcgggaagcctttcacgccgttacgggtgttacggaacagcacgcggctggtgccgtgtctgtccatcagcatgttgatcagctcctgacgggcggattcagcgccgtcacggttgctgttggcggtttgcagcagcggttcaatgtcctgctcgccaatcagttcacccagcgtgttcagctcgctgtcggtaagggtttttcctgccagcagcatggcgaccgcatcggccaccgggcgatagttattttgttcttcaacaaactgcgcaaagtcgtggaaacggttcggatccagcaggcgcagacgcgcgaagtggctctccagtcccagctgttccggcgtcgcggtgagcagcagcacccccggcacacgttccgccagctgttcaatcgcgaggtattcgcggcttggcgcatcttcgctccacaccagatggtgggcctcatcgacgaccatcagatcccattcgccgtcgcacaggtgctccagacgctgcttgttgcggcgcacgaagtccagcgagcaaatcactaactgctcggtttcaaacgggttatcggcgtcgtgctgggcttcggcgtagcgctcgtcgtcaaacagggcaaaacgcaggttgaagcgccgcagcatttccaccagccactgatgttgcagggtttccggcaccacgatcagcacgcgctcggccgcgccggagagcagttgctggtgcaggatcatgcccgcttcgatggttttccccaggcccacttcatccgccagcagtacgcgcggcgcatggcggcggccaacatcgtgggcgatatgcagctggtgcgggatcaggctggtacgctgaccgcgcaggccgctccacggcatccggtactgttcgctctggtacttacgcgcgcggtagcgcagcgagaagcgatccatacggtcgatttgaccggcaaacagacggtcctgcggtttgctgaacaccagtttgctgtccagcagcacttcgcgcagcatgacgttcgcctcgccggtatcctggcgtgtacctatgtaggcgaggaggccgttttctgcttttacttcttcaatattgagctgccagccttcgtggctggtcactgtgtcacctggattgaacatcacgcgggttacgggagcgtcgctacgggcatacaggcggttttctccggtggaggaaaaaagcagagtgacggtacgcgcatccatggcgacaacagttccaagtcccagttcgctttctgtatcgctgatccagcgttgaccaagtgtaaaaggcatatgtattcggctctatatctctaattgcaggcaatagtttgaccaccgtctgaaagcgacggcacatcaaaatttggggccaggattgggaagggcgctatggtactggaaggcacagctttcgtcaccttttcgtcatcattcaaaataacccaagctggccggtaacaagtgtagcaaaatcatcgtggaggaaaggcagaatgccgtccgccaccggttgtagctgtttggtcagatagtgatcgtagtccagcggcgactgctgataggccaccggctccgggccgttcgtcgtccagacgtacttaatggtgccgcgattctgatactgcaacgcgcggcccattttctggttatgttcatccgccagccgtgctgcgcggacgtgtggcggcacgttgcgctgatactccgccagcgggcggcgcaggcgtttacggtacaccagccgatcatccagctcgcccgccatcagctgcgcgatggtttcccgcacataatcctgatacggctcgccgcggaaaatgcgcagatacagcgactgctggaactgctgcgccagcggcgtccagtcggtgcgtaccgtttccagccctttaaacaccatgcgctggctgtcgccttcctggatcagcccggcataacgtttcttgctgccggtatccgccccgcgaatggtcggcatcaggaagcggcaaaaatgggtttcaaactccagctccagcgcgctggtcagcccggactgttgcagatgtgtctgccaccaggcgttaacgtgcgccaccagcgcctgaccggtttttgccgcctcttcttcgctgtgcgcgcctttcagccacacaaaggtggaatccgtatcgccatagatcacatcaaaaccctgcgcttcaattaacgctttggtctgcaacatgatctcatgcccgcgcagggtgatggacgaggcaagccgcggatcgaaaaagcggcaggcgctggtgccgagcacgccgtaaaaggagttcatgatgatcttcagcgcctgggacagcggtttattgttgaggcgtttggcctcatcccgcccctgccagacctggccgatgatctccggcagacagtgtttttcccgtgaaaaccaggcgtcgagaaagcccggtatgctgtgctgcggatccggctgcgccatgccttccaccagcccgaccggatcgatgaggaaggtgcggataatggccggataaaggcttttatagtccagcaccagcaccgaatcatacagccctggccgcgaatccattacgtagccgccggggctggcctgcggcggcacatcgccgaggttgggcgcgacgtagcccgcgcggtgcatccgcggaatataaaggtggctgaaggcggcgacggatccgccatggcgatctgccggcagaccgttgaccgtggcgcgctccagcaggaagggcatgatggcggttttatggaaaatacgcgtcaccagctcgcagtctttcaggttataagtggcgagagcgggtttgttttcggcaaaacggcgttcgatctcatccatgcgatcccagggattatcaatagctttaccttcgcctaatagttcctgcgacaccgcctccagcgaaaacgacgggaagctccagaacgctgatttcagcgcatcgatgccgtcgatgatcaaccggccattggcctgggcgaagaacacgccgtttttaaagccatgctcgcgccactccagatcggtgctgccgcgcccaagacgcagcggaataccgtaacgctcggcatgtttttgcagcacgcgcaggtcgaactgcaccacgttccagccgatcaacacatcgggatcgtgagcggcaaaccaggcgttgagtttttccagcagcagcgggcggctggagacatactccagatgaaaatccacgccgctggcgtcgccattttgcggaccaagcatatagaccgtgcgctggccgcagccttccaggccgatgcagtacagctcgccatgacgggtggtttcaatatccagcgacacccatttcaggggcggacgataagcgggatgcggctttaagcgcgcgttgatcagcgaaccgttgtgcgcgtcgccgtcgacccacaccggcgcggtaataaagcgctccatcagaaaacgctccggcgggcggatatccgcttcaaacaccgtgacgccgccttcgcgcagcagtttgtcgtagcgcatcagctggcgatgggcgcggcaataaaggccgtgcaccggctggcgatggaaatctttcagcgccagcggcgtgaggcggtactgggattcaccggcgagaatgcgctgcgcctgcggcacctgttcggaggggataaacgccaccgattcctgcggcggcagcaccacgtgcagcggcccgtcatccgtggccagccagaattccacctcggtccctttgggggtatcccgccagtgccgggtcagtaaaaagccttctcgcgcctgcgccacaccgtgctctcataaaaataaaccaggcataattatagcctggttcggaggtgggtgctggtgttttatacaggtattactgcccgtagtaggctttcgcgccatgcttgcgcagatagtgcttatccagcagggtttgttgcatcgcggggagatccggcgtcagctggcggctgaaaatgcccatataggccacttcttccagcacgatggcgttatgtaccgcgtcatcggcgtttttgccccacgcaaaggggccatgggaatgcactaatacgccgggcatctgtgcggcatcgataccctgtgtcctgaaggtttcgacgatgacgttacccgtttcccactcgtattcgccgttgatttccgcgtcggtcattttgcgggtgcaggggatcgcgccgtagaaatagtcggcatgggtggtgcccgtcgccgggatggattgtcccgcctgcgcccagatggtggcgtgtcgcgaatgggtatgcacaatgccgccaatggacggaaaagcctgatacagcaggcgatgggtgggcgtatcggacgacggttttttattaccctcgaccacttcaccggtttcaatgctgaccaccaccatgtcttcggcggtcatcacgctgtaatcgacaccggatggtttaatgaccaataccccgcgttcgcgatccacggcgctgacgttaccccaggtgagcgtcaccagattgtgctttggcagcgccaggttggcgtccagcacctgacgtttgagatcttctaacattcatctctccacgccggatggcgcgttgcttatccggcctacataaacaacgcgccatcgggcattaaccattaacgtttcgaaccgtaatacacctcgttccagcgcagcgcgtctttgaacgcgggcaggcgggtgtcgttgtcgatcactgtcagttcaatgccgtgcagttcgctgaactggcgcatatcctccagatccagcgcatggctgaagacggtgtggtgcgcgccgccggcgatgatccaggcttcggaagcggttggcagatccggctgggctttccacagggcgttggcgaccggcagcttcggcagcgcatgcggcgcttcaaccgagtcaacgcagttcaccagcagacggaaacgatcccccagatcgatcaggctggcgttgatcgccggacccgttttggtggagaagatcagacgggccggatcggctttgccgccgatgcccagatactgcacgtcgaggatcggtttttcgtccagcgcgatggtcggacacacttccagcatgtgcgagccaagcaccagatcgttgccgttctcaaagtgataggtgtagtcctccataaaggaggtgccgcccggcagaccggtcgccatcaccttcatgatgcgcagcagcgccgcggtcttccagtcgccttcacccgcaaagccgtagccctgctgcatcagacgctgcaccgccagacccggcagctgttttaagccgtgcagatcttcaaaggtggtggtgaacgcgtggaatccgccctgttcgaggaagcgtttcatgcccagctcaatgcgcgcggcgtcgataacgttctgccgtttatcgccgttgatctgcgccgccggggtcaggcggtagctgctttcatattcatccaccagcgcgttaatatcgccgtcgctgatgctgttcaccacctgcaccagatcgcccaccgcccaggtattcaccgagaagccgaatttgatttgcgccgcgactttatccccgtcggtcaccgccacttcacgcatgttgtcgccaaaacggcacactttcagatgacgggtgtcctgtttcgacaccgcatgacgcatccacgcgccgatgcgctgctgcgctttttgatcctgccagtggccggtcaccacgctgtgctgttgacgcatgcgcgcgccgataaagccaaactcgcggccgccgtgcgcagtctggttgaggttcataaagtccatatcaatgctgtcccacggcaggctggcattgaactgggtatggaactgcaacagcggtttattgaggatggtcaggccgttgatccacattttggccggggagaaggtgtgcagccacaccaccagacccgcgcatttgtcgtcatagttggcgtcgcggcaaatcgcggtgatctcatccggggtggtgccgagcggtttcagcaccattttgcacggcagcttcgcctctttattcagggcattcactacctgttccgcgtgggtggtgacctggcgcagcgcttccgggccatacagatgctggctgccaatcacaaaccacacttcatagttatcgaaaacggtcatttatcgtgtccttaatgagtcagcgctgcctgcgatgcgggggcagctgaagggagatagtgttgttcggcgcttaccgcccactgttgatagcggcgatagagctgttcaaaacgttgcgcctggcgcgggtccggttgcagggtgttttcgatgcggctggccatcgactgctgggcggtgggaatatccgggtgatcgcccgctgccacggcagcaaaaatagccgcacccagggcgcagcactgatcggaggcgacaatctgcagcgggcggttcagcacgtcgcagcaggcctgcatgatgacgcggtttttacgggcgatgccgcccagcgccatcacgttatttaccgcgatcccctgttcggtgaagcactccataatggcgcgcgcgccaaaggcggtggcggccaccagtccgccgaacagcagcggggcgtcggtggcgaggttgagatcggtgatcacccctttcagacgctgattagcatccggtgtgcggcggccgttaaaccagtcgaggatcaccggcagatgatccagcgacgggttatccgcccaggcctgggtgagcgccggtaacagctgtttctggctggcgcggatctgcgttttcagctccgggtgttgcaacgccagctgctccagcggccagccgagaatgcggccaaaccaggcgtagatatcgccaaaggcggattgcccggcttcaagcccgataaagtccggcaccacgctgccgtccacctgaccgcagatgcctttaacggcgcgatcgccgacgctcggtttatcggcgatcaggatgtcgcaggtagaggtgccgatcactttcaccagcgtgttcggctgcgcgcccgcgcccactgcgcccatatggcaatcaaaggcgccgccggcaatcaccacgctttgcggcaggccgaggcgctgcgcccattcggcgctgagcgtgcccaccggaatatcggcggtataggtgtcggtaaacatcgggtagctgagatgtttgttgatcagcggatccagctcatcgaagaaactggcggggggtaagccgccccagctttcatgccacagggatttatggccggcgctgcaacgaccacggcgaatagcctgcgggcgggtggtatcggagagcagggcagggatccagtcgcacagctcgatccaggaggcggcggcctgcgccaccgcggcgtcggcacgggtcacatggaggatcttcgcccagaaccattcgctggagtaaatgccgccgatataacgggagtaatccacttttccggcggtgtggcacaggcgggtgatggcttcggcttcttcgacggcggtgtgatctttccacagcacgaacatggcgttcgggttatcggcgaactccgggcgcagggccagcacgcggccttcggcatcaatgggcgcgggagtggagccggtgctgtccacgccaatgccgctgacctgcgcgcggtgctctgcgctcagttccgccagcacgcttttcagcgccgcctccatcgactcgatgtagtcgcgcgggtggtggcggaactggttatgaggagcgtcgcaataacgcccttcctgccagcggggataccattcgacgctggtggcgatctcctcgccgctgacgctgtccacggccagggcgcgaaccgaatcgctgccaaaatcgaggccaattgcaattgccatcgtgttactccatcaagaataagcgtatggagaaacattagagacagacgccggaaagggtcaggcaggatccgctaatcttatggataaaaatgctatggcatggcaaagtgtgacgccgtgcaaataatcaatgtggacattccgcctggctttatagacacttttgttaagccttttttgccggtgtgtggaaacaaaaccgggcaaagtgcttttatctggcggggttggtgaaggctgttttacctgcggaaggcaccgccgggggatttgatgatacaaatcacaatatggacaattggtttcctttaatgacatccggagtattgccattatggctgaaccgcaaaacgatccgctgctgcctggctactctttcaatgcgcatctggtggcgggattaacgcccattgaggcagacggttacctggattttttcgttgaccgcccgctgggcatgaagggctatatcctcaacctgacggtgcgcggcgaaggcatcatcaataacaatggcaaagagtttgtctgccgtcccggcgacatcctgctctttccgcccggcgaggtgcaccattacgggcggcatcctgacgcgcgggagtggtatcaccagtgggtttatttccggccgcgcgcctactggcatgaatggctggcgtggccgacgattttcggtcagaccgggattttccgtccggacgaggcgcatcaggcggccttcagcgagctgttcgaccagattatccatgccgggcagagcgccgggcgctacgccgagctgctggcgatcaatctgctggagcaggtgctgttgcgccgtatggaagccattaatgaatccctgcatccgccgctggataaccgcgtgcgcgatgcctgccagtacatcagcgatcaccttagcgacagccattttgacatcgccagcgtcgcccagcatgtctgcctgtcgccgtcgcggttatcacacctgttccgccagcagctgggcgtcagcgtgctgagctggcgcgaggatcagcgtatcagccaggccaagctgttgctcagcaccacgcggatgcctatcgccagcgtcgggcgcaacgtcggctttgaagatcagctctatttttcccgcgtgtttaaaaaatgcaccggggccagtccgagcgagtttcgcgcaggatgtgaatgaaacgtaaatgaaacgaaaagagatgtccggtggtctgagttaaccagtaaactacttatcagatcatttaatcgggcaggttatgcaggcatttctggaacattttattacgcagtcggcggcgtattcccttatcgccattgcgctggtggcgttttttgagtcgctggcgttagtcgggctgattttacccggcacggtgatgatggcggggcttggggcgctgattggcagcggcgaggtcaatttctggtatgcatggctggcgggcatcgtcggctgtctgctgggcgactggatctccttctggctcggctggcgctttaaaaaaccgctgcaccgctggtcttttttaaagaaaaacaaagcgctgctggataagaccgagcatgcgctgcatcagcacagcatgtttaccattctcgtcgggcgttttgtcgggccgacccggccgctggtgccgatggtggcggggatgctggatctgccggtggtgaaatttattctgccgaacattatcggctgcgtgttctggccgccgttctactttttgccgggcattctggcaggcgcagccattgatattcccgcggatgagcagagcgggggcttcaaatggctgctgttgctggccgcggtgctgctgtggctggcggcctggatgtgctggcggttgtggcgcagcgcgaaggccagccccgacaagctgacgcgctttctgccgcgcgcccgtctgctgtgggtagcgccgctgctgctgggtgtggcggtggtggcgacggtggtggtgatccgccacccgctgatgccggtgtatgtggatattctcgggaaggtcgtcagggggcattgacggggcattgccgggtggcggctgcgccttacccggcctacacgaacatcattgcttcaggtttcgtaggcccggcaagcaacgcgccgccgggcaacacggcccaatttacacgaacatcattgcttcaggttttgtaggtccggcaagcaacgcgccgccgggcaacacggcccaatttacacgaacatcattgcttcaggttttgtaggcccggcaagcgacgcgccgccgggcaacagggctccattattccacccgcacattcacatgcccgaacgggggcacctgatgaacggccagcggctcacccagcgcattgcacgtctgccatccttccggcacggttagcgagtgctcaccagggttaaacagcctgaccagcatcccgccatacagcacatccacgccgctgaccgccagcccttcggggatctctgccagcgactgccgcacccgcaccggctgcgccggtaaaaagacgtcgaaattatccagccgctgcacgcatttttcgtcaccctgccattgccagagcgtcgggttaacccggaagcgctgggcgcaggccacccgctcatcggcggcaagcggcgtcagacaaagcgcaaaatcaaagctcagcagtcccggcagttccgcttccggcgtcgccagccgctgacccgaggcacgacccggccgccacagcaaatcatctttgcccagctgcgatgccccgcgaaaaagcgttacgcgcagcaggcgctcctcgtattcatactctttcaggccgcgggcgaaaaaatggaaatcgtcgtgggcgcgcagctgatgcataaaaggctcgatgtccaccggccgctcggtgaaatctgtccgcgcactgtccggctggttctgccgggtgatccagccgaagggcatatccgcctgcaccgcggcgatgggcgtgccggtgtcgaaaaccagctgcatccggtgctcacgcacctgattatccaccgtcaggtgaaaacggatcagcgcctcttccagcgtcacggtcagcgtcaccgccacggacttcagatgcccgctgcgcccggtgcgctgcgcattcaggcactccggcagcgacagcaggctggcgacgatcatctcctgtttcgccggatgctgcttcaccgaaaccagttccatccagccggaacgtaactccacgtcccccgccagcggcgagaagtcatacagatcgccgtcgttacccagatcgctcagctggatcagccgcgtcagcgtgcacgggcggcgcttatccaccaggcacagattctgatcctgccagctgatgcggtagtgggcgttctcgataaaggtctggcgcagggactgcatccacggcatcgccgcaggttcattgtgctgcacaaaaaacagcgccatccccagcggcggcacaggcgcatggagaatgtccacccggttgcggtagtaatagtccgccgaaaaggtctccacttcgccgtcgggcgtcagcagcaccgcccgcggtttgcggattttttcctgcgccagcaggatgaattccaccggcagaccctgttcatccaccagccggaacccaggcgtcggcgtgatcagcacctgattgtgtgcgcagagggtgggcgcgcccgtgccgttaaccagcagaaaacggtagtcccgatccgcagccaggtttgccagcagcagacgggcgtgcaggctgaacagcgcctcgccgatctgccgggcgtgggcgcagcgggccagcacgtcgcggttggtttcatcgctgttgcagccgcccatgctgtcgtgggcgtgggactccagcagcatgcgccaggctttttccagcatcgcttcgctgcaggccagcccgttcaaacgcgccagcgccagcagcggttcggtctgatggatcagctgcgtttccgcatcgtcgttcgcgcgtttaatgtcgtagcgcgaggagccaatggttttatgcactctggacaggtgaggacggcggaactccccctgccatacggcgaggtcttcctcgttcagcgccgcgaagtaatcctcatagctgctgacgataaattcatcctcgctgtgggcgttaagctccgcgataagcctcgcgaaatccccgtcgcagctgacctgatcgccgccaatgggacacagcagatggcggcagggagtgagctgtttaagccgggcgatgagcgggaaggtttctgtctcaacatgcgatagcgagaaattacgccagcggccgccgcgctccgggtgcgccagcgaatagccaaacggcatgatcgccgtggtgatggcgtcgccgttcgccgcctgccagcgcatttccgtcgcgcccatcacctcaggatcgtagccccggcgcagcaaaatatgccgcagcccgaaggccgctgtcagctgcggcaactgtgccgggctgccgaaggtatccggtaaatagagcacgtccatgcagccgcctgccgcgcgggcaagctcaatgccgatgcgcaggttgcggaacacggattcggtgctgatgctgaacagatccggctgcgtataccaggggccgatcagcaaccgacgctggcgcacctgcgccgtcgcccgttcggtcatctccggtttgagctgtaaataatccgccagcagggagctttgtccgtccaggtggtacaccagttgcggatgagtttctaaggcttcaatcgcctccgtgaaggccttcagggcgaacacctgggtgtcgagggtggtgaaataccactccctgtcccagtgggtatgggataccgcatgaataatacgcttgtcgttcattgactttccttgtcgctggccatttccagcaggtattcggcatgaatatcctcgccgtaccacatcgggaaattggtgccccagatattgttatacaggtgggcgaaaatgccttccggctcgtcatgcggctcgccaaaccacagaatgcgcggctcatgcagggcgaccagcggcgcgtcgagcggctgtaattgccagtcgggggtgaaaacgcgctcgacgccgtgcagattgcggttgccgttgcgcgccacctgctgccagtcgatggtctggccgattttgcggcactgactgcgggatttatcgataagcccgaattgcagccagatctcctccggcaggcggttcgcctgtttaccgataatggatacctgatagcgaatggcagggcgatctttaccaaaacgccagctgtgccgcactttttccggtagccgcagcaccatgcccgcctcgttttgcacaaaacgcgcctcgataaaaagctgatactcgtccggcgtctcctccacgcgcacctcatgcagccgcagcgtggcgcagcgggaagtcacgggcacggcggtcagctccagccccggtttggtaaagtcggctatcgcccagtcgcgggtggtggtcagattttgcagataatgtctggcaaaacgctgatagtcgtcatcgcttacctgccggtaaatcactctgcccagtggcgtggcagagaacaccttaccgccgacgctcagggtgctgaggctgccatcatcggcgatataaagatgataatcgccgaaagtgcgtgaacgtcggttgacgataatgccctccatggcgacgggggcgaggggggtaaatttctctgttattgcaggcggcagacaggcgagagcgttatcaatgtaatcgcgctgctcctgccaggagacggcgatgttgtgatagccaggcgcacggcggtgcggcagacgcgcggcaaactcttcgataaagcggtacggctccgggatgccgttttccacacgatccgcctgccgcgccacgtcaaattcgccgggcaggtagtggttgtaatccgccagatgcagcttgagatccatcccccaggtgtgctccggcaccatgatcagctgcgccatcgcctgacgatacgcctcgctggcggcagagatccgcccggcggacacctcctctgccagcaatcgcaccagccgcagatagcggctgaccttgcccggatcggtcgccagtccgtgattccaggtgtcgccaatttcactgtcgattaccggtaattgatgtttgatggtttccacgcgggcagcaaacgcatccagcgtggaggcgctgacctcggcgtcgggataacgcgcctggtagcgggcgagagtggcataaacctgcgcggcgtcgggcggggcgcagttatcggcggcgtgacagaacaccagtaactcgtcgagcggctcgcaccagtattcgttgccatagcctcccggcgaatagttgacgataatttccgcctccccgagtcgccagcggaacagcggcggcacgtccggtgcggtggaggcttcattaacgccgaggtgtaaataagcgataccggcctcggccagccagggaatgatcgcctgggtatagccgggcacgtcggtcattttggcggcgatagtgcgcttattgaaacgcagatccagatccatcgcatagtcgagcccggattgcagggtgccggcgctgagcagttcgctgtgggaagtaaaaggcaggccatgccagacgatgtcgccgcgcaggatggcgtcagtcagcgctcgtcgcccctgatcgtctgccgtctgtaagaagcgggtgataagccaggccccgcaggtccagataaagtttttcgtccccggccggttcaccttctgcgccagctggatcaccgccgggataaactcatgcaggtatttatcttcgacggtgcgggccagatcggtaaagccaatatccagatgcgttttgtagatgatatgtacacgttgcacgggattatcctcgataaatagggttggtcagcaattgcgccaccgggccgcggttgatgcgcagcagggcgaaggccgcatcctgcacgtcaatttcctggttcacatcgccgtagcgattgggcaccacgatgacggtgttgtcggtgtagagcagcacgctgttgtctttatgggtgcggagtttgacgtgcaggatcccgccgctggtggtgtcgcccgggcctgcctcgccaatacagaagcggtgcaactgcgtctggtcatcgctttgcatatagctgcgcccggcgaccagcgcagagaggatgtcctggcgctcgcggctgatggcgcgtacccacatgtacggccagcgcagccctttttctttatgaaaatcgctgcccgccacggcgctgattttttcgccctggcagagctggtgatgccagtagttaaaagcgtcttcgttgccggtctgcccgtcccacggcccgttccagatctccagccagtcgtggtccgcaaaacggttctgccacgggcagtagtggcagaaagggtgattaataccgatgcgcgccccgttgcggcgggcttcggcaatgcgcccggcgatgtcatcttcggtaaaatgcggcagaaagttcaccaccggccgggtgacgcccagcaggttggcgtggccgcgctcgctggtcagctccatgccggggatcaggcacagtgaggcgttaatgcccgcgatttcatggttctgcgaaatggtgttgtgatcggaaaaacagaggaaatcgaactccatctggcgggcgcgggcaatcagttcgttcaccgttaagctgccgtcgctgtgcacagaatgcacatgcgtgtcgcctttcagccagcgcggaaatttcgggtacagggtgatctccaccaccacttcgcagaggcggcggatcttatgcagcccgagcagcacgtgccatttgccgttaacgatgctggtgcgctggtagccgggcgaggcgaaattttcgctcagcgtgatggttttacgcgcgccgccgctccagccgttgatgcggtcattgatcatcagccccatatccaccacgttacccggcgtgaagcggtagctgatgtcgatgcgctcggtattcagaccgggatcgaactccaggcggcgcagggttttttcctcatggggtgaaaccttcaggatacgggtcagtgtcaccggctcggtattcatgctgtttctccttcgtctaacagttccttgcagtcaccggcgatcatcaccacctcggcgccataaataatctggaaggcccgttcgctgacctgcacatagcctttcgcccgcagcgttttcttccacaccgcttcaggggcgacgcgggagccgtctttcacctgaacccgcaggcgtgaaatgcagttgtcgaactgctcgatattctctttgccgccgaaagcctcgatgatgtgccgggcgaagcgcattccctgttgctcgttaaaatcctgtttgctgtaaagccgggtagttgcctcatcctcttcgcgccccggcgtcatgacgttgaagcgcaggatcaaaaagcgaaacagcgcgtagtagagaacaaaaaacagcggtaccagccacagatagccccataaattgagtttcgcgggctggagcagtaccggcaggatgtctttcaggctgccgccgtagatcgacacgtttgccatttcggtaagcacaaaggcgaggccagtcagcggcacatgcaccagataaaacagccagggagcgacaaacagaaaggtgtattcgatgggttcggtgacgccaaacaggatcatggtggccaccaccgggatcagtaagcccgccacgacttttttatgcggcgatttcgcgcactggtagatggccagcgccgcccccggcagcgcgccgaaatgcaccaccacgcggccggactgaaagccgcgcaccagcagctgcggcgtcccctcgcaaccgagctgcgccatatagatattggtggtgccgcttaccagctggttgcagacggtcatggagccgcccagttccgtcagtcggatcggcgtggtgatcagatgatgcaggccgacgggcagcagggatttatccgccaccgcccagataaaggtgccgaacagaccggaattaccgataagcctgctgaactgcgccagcatgccgcccagcggcggccagataacataaagcagcacgccgagcagcgatccggccatcagcgtgacgataggtaccgtgcgcgtaccggcaaaaaaagagagtaccagcggcagtttgacgttatataagcggttatgcagcccggcggtgatcagccccaccgccataccgccgaatacgctcatgcggtaggagaacatccccagctcgctggtataaatcgaggcgcgctgtacggcggcaatgtcattcaaatgctgttgctgccggaaaaattcaacgctggtggtttgtggcgtaataccatttaattccagcagcgtggcgataataaaatgcatcgccataaaacagaccgcgccggaaaacgccgcccagcctttttcttttttcgccagaccgaaggccacgccaatggcgaagaacagcggcaggttgcgaaataccacgtcgccggtggccttcatcacgctgaaggtcgtaaataaaagcgagcctttggtaatgatgttctgtaaatgcagcgcttcgatggtgccgctactggtgaaggcgctgccaaagcccataaacattgagccgacggtaatgatggagattggcaccagcatcgcctggccaatcatttgcattgtttgcttcataaaaatccttttttacgggctttaattattcatttgaataatgtattgaagcactccggtttatttgttttgtgtgatattgactgcgataattactattccgctattttctttcttctcctgaaaataattatttattatcaggctgacgagcgcgaatataacgatttaacggggcgggttttgtgatgtgaacagcgtaacgctatcaatgcagaggatatttgtaagcaaaagatgccgcggttcacggcattattagcggtttcgttatcaggaaagggatggcgcgggcagaccatcgacgctgatttgcccgtcagccaggcgaataacgcggggaaagtggcggcgggtaaaatcatcatcatggctgatggcgagcaacgtcgtctgccgctggcgacagaccgccagccacgcttcaaagcgtgctaaccagcatgcgtcaaaatcccggctcggctcatccagcagcagcaccggcggggccatcgcctccaggcttgcgaccgccaccattcgccgttgggcagcatgcagatccagcggatgcgcctgcgccacgtccgccaggccgcacagctcaagcgccgcgcggacgcgctgctcaataacggtggtgggcaatttttgcagcttcaggccaaaagccacttcactcagcaccgtgctgtgcaggatctggttttccgcctcctgaaacagcacgccgatctgcgcggcgcgttgcggggcgttcagcgctgacagcggctgccctttcagtaaaacttcaccctgctgcggggtcagcagacccgccatcaggcgcagcagcgtggattttccggcgccattatcgccggttaacgccacccattcgccgcgctcaatgttcagcgtgaggtgatgcagacagttttccgcggccgcgggccagcggaaggtaaggttatgcaaagcgatcatagagcggtcagtcctgtttcatcgagctgccacatctggcggcaaaacgcctgcgctggctggcggtgacgttcaaagagcatcaccagcgccccgctggcatctgcccatgccgccaggcggctaagcatctgttgcgtggcctgcggcgtcagacggctgaaggcctcgtcgagcagcagcaggcgcggctgcatcgccagcgcacaggcgatcaccacccgctgggcttcgccgccggagagcgtggcggggtgccggtgacgcagcggcaggcaatcggtgagcgtcagtgcggcttcaagccgggcgaggatctcaccttccgccaggcacaggttttccggcccgaaggcaacttcttcttccacgctgaaggtacagccggagagttgcagggcaggggactgctgcaccagctgtacggtctgcgcctgttcgggctgcgaccgttcacccggcggctggcccaggatccgcccggttccgctaagggtgccgggcagataatccggataccatcccgcaagcagctgcgcgagggtgcttttgccgctgccattaccgccgaggatcgccaccatgcccggctgtgcgatctgcaaattcaggctacgcggcggcgcggcgctgtgcgtgggctgaaagcagaggttttctagcgtaaccatagccaggctccggtttctgccagcatcagcgcgagcagggtataacgcagcgcgcgctggcggcggctgtcggggggcgcccataaagtcgtgcgcgtgcggtgcagacgaaaggcgcgcatgtccagcgctgcgccgcgtaccggcagatcgttaagcgcgccctggatcagcggtacgatcagcgccgggacggcacgcagccgctgataccagcgcccgtccagcgggacgcctcgtgcgcgctgcgcttcgtgaatgctcgccagccggtgtttaagctgctcggcaatcagcagcggcccggagaacagatacgccacgcccggcggcagccggctggcaaaaagcgcgcggataaactgacgtaccggcacgaaagccatccacagttgcgacgtggcgacgatggtcagaatgcgctgccacaggatgatcgcctgcgcccagtggctggcatcgcgcggctcaccgctcagccaggccaccagccagccgccgtgcaccagccacatgccgacgccgagcgacgccatcagccaggccacatagcgggcgcggggacgggtagcgcggaacagcagcaggctgatgaaagccgcgccgcttaccaccgtcagcagcggcccggcgggcagcagcagcgccgaccaggcccccagactccacagcgtcagggaggtaaaaggatgcattcagcgtacggccgacatggtcgggaaacggcgcgtggtgcgcagcggcaactgacgcagcaggatccagacgatcgccgccgtgaggatcttatccaccagattcgcgcccaccaccgtcagcgccacggattcgatcagatcgttccccatggatcgcgcccaggcgacaaccagatccgcgccgctgccggtgacgccgccaaacagcgcggtgcggatcggcaccgccactatcgtgaccgccagggtgatcaggatcccgctgaccaccacctttggcagggtgcggaaccagccgagccgcgccagccagcctgccgtcagacctatcaccatcgccacaggtgcaaaggcggcggcaataggatcggttaacaatccccacagcaggttagtgagtaaaccggtcagcatgccgacaaccggccccagcaggacggcgctcagcagcgtgccgatagaatcaagaaaaattggcagcctgagcatactgataagctgcccgccgatcatattgatggcgacggaaataacgatcagaaccagcgtctggctggagagtgggcgacgcgccatagcaacctctttgatttaagcgacagttaacgggaatggacaacgagttcgtcatagccggagagcgggcagggctggcgcgaaaacgacagcgccgtcagttcgccaatcaccagttccagggtggtgcgcaccgtgcagccggacataacgtgaccgcccagcagcgcgccctgttcgtcggcaatgctcaggtgcagatgctcccccgttaattccagcgtgccggacagcgagatgagttcgtaggtgccggtaagccgggtgctttcatcgcggcccgcatagcgcagggcgacctccgtcaggctgccggtagcgccggcaatccatgcggcctgtagcccgtgaagggccataaactgacgtaattccgttaacagctcctgaccgggagcgaggcgcagcgcgtaaaaccgcgccgcagaggcaatggactgattcatgggatgagtaaactccgaaactcggacgtgggccgaatattaagagtgacggcggttctgtgtactgatgtatatcattaaaatattccgccgttatgacgcttttattctttagaaatgcccgttacgggaaaggatggccgcaacgtgagggggtaaaagtgtgatgcagatcagattactgtcgttcatcgccgggcgtcgattccttttattccgcgtttcgcttattctagctgaagcgtttcagtcgattaaattttcgacaaaatattaacaggtcgcagtttgcgacaggtaaggtttcccttgttgtgccgctgcattattctgtcagccacagcaaatcagggacagccttgcaggagatctatgaccgtacgcgtggcgataaatggcttcggtcgcatcgggcgtaacgtggttcgtgctttatatgaatccgggcgtcgtgcggaagtgagcgtggtggcaatcaatgaactggcggatgctgcgggcatggcgcatttgttgaaatatgacaccacccacgggcgtttcgcatgggatgtccgtcaggaacgcgaactgctgtatatcggcgatgacgccgtccgcctgctgcatcaggaaaccattgaggcgctgccctggcgtgagctgggcgtggatgtggtgctcgactgcaccggcgtgtacggcaatcgccagcacggcgaagcgcatctggcggcaggcgctaaaaaggtgctgttttcgcatcccggcagccacgatctcgacgccaccgtggtctttggcgtaaatcagcataccttgcgtgaagatgaccgcattgtatctaacgcctcctgcaccactaactgcattattccggtgatcaaacttcttgatgacgcttacggcattgattccggcacggtaacgacaatccattcggcgatgaacgatcagccggtgatcgacgcctggcacgcggatctgcgccgcacgcgcgccgccagccagtccatcatcccggtcgataccaaactcgcggcgggcatcacccgtttcttcccgcagtttgaagataaattcgaagccatttccgtgcgtgtgccgacgataaacgtcaccgcaatcgacttaagcgtcacggtgaagcaaccggtaaaagccatagaagtcaacctgttgctgcaaaaagcggcacagggtgcatttcatggtatagttgactatacggaattaccgttggtctcagcagattttaaccacgatccgcacagtgccattgtggatggtacgcagacgcgggtcagtggggcgcacctcatcaaaacgctggtgtggtgtgataatgaatggggctttgctaaccgaatgctcgacacgacgttagccatggcagcgactggtttcaggtgagatgcacattgcatctgccaaactttaaaaaaaacgagaggattcaccatgtctgtaattaagatgaccgatctggatctggctggtaaacgtgtttttatccgtgcggatctgaacgtaccggttaaagatggcaaagtcaccagcgacgcgcgtatccgtgcttctctgccgacgattgagctggcgctgaaacagggtgcgaaagtgatggttacttctcacctgggccgtcctaccgaaggcgagtacaacgaagaattctctctgctgccggtagttaactacctgaaagacaaactgtccagcccggttcgcctggtaaaagactacctggacggcgttgaagttgccgcaggcgagctggtagtgctggaaaacgttcgctttaacaaaggcgaaaagaaagacgacgaaaccctgtctaaaaaatacgccgcgctgtgcgacgtattcgtgatggacgccttcggcaccgcacaccgtgcgcaggcttccacccacggcatcgcgaaattcgcggacgtggcgtgcgcaggtccgctgctggcggaagagctggacgcgctgggtaaagcgctgaaagaaccggctcgcccgatggtagctatcgtcggtggttctaaagtctccaccaaactgaccgttctggattccctatccaaaatcgctgaccagctgatcgttggcggcggtattgcgaacaccttcgtcgccgctcagggtaataacgtaggtaaatccctgtacgaaccagacctggttgacgaagcaaaacgtctgctgaccacctgtgacatcccggttccgacggatgttcgcgtggcgaccgagttctctgaaaccgcgaccgcgactctgaaatctgccagcgacatcaaagatgaagagcagatcctcgatatgggcgacgtttccgcacagaaactggctgaaatcctgaaaaacgccaaaactattctgtggaacggcccggtaggtgtgttcgagttcccgaacttccgtaaaggtaccgaaatcgtggcgcacgctatcgccgacagcgaagcgttttccatcgccggtggtggtgataccctggcagccatcgatatgttcggtatcgctgacaaaatttcctacatctccactggcggcggtgcgttcctcgaattcgtggaaggcaaagtgctgcctgcagtagctatgctcgaagagcgcgctaagcagtaagtttgatcaggcggggaaacccgcctgattttcagcgcgctttactaaagcacgcgctccctttttctaacggccaagatacaggactacgtaacatgtctaaaattttcgatttcgtaaaacctggcgtgatcactggtgatgacgttcagaaagtgttccaggtagctaaagaaaacaacttcgctctgccggcagttaactgcgttggtaccgactccatcaacgccgttctggaaaccgctgcgaaagtgaaagcgccggtaatcgttcagttctctaacggtggcgcagccttcatcgctggtaaaggcgtgaagactgatattccgcagggcgcggcaatcctgggcgctatctctggcgcgcatcacgtacaccagatggctgagcactacggcgtgccggtgatcctgcacactgaccactgcgcgaagaaactgctgccgtggatcgacggtctgctggacgcgggtgaaaaacactttgcggcaaccggcaaaccgctgttctcttcccacatgatcgacctgtctgaagagtctctggaagagaacatcgaaatctgttccaaatacctggagcgcatgtccaaaatcggcatgaccctggaaatcgaactgggttgcaccggtggcgaagaagacggcgtggacaacagccacatggacgcttctgcactgtacacccagccggaagacgttgattacgcgtacaccaaactgaacgctatcagcccgcgcttcaccattgcggcgtccttcggtaacgtacacggcgtttacaagccgggtaacgtgaaactgactccgaccatcctgcgtgattctcaggaatacgtcagcaagaaacacaacctgccgcacaacgctctgaacttcgtgttccacggcggttccggttctactgcgcaggaaatcaaagactccgtaagctacggcgttatcaaaatgaacatcgataccgatacccagtgggcaacatgggaaggtatcctgaactactacaaagaaaacgaagcctatctgcagggccagctgggcaacccgaaaggcgaagaccagccgaacaagaaatactacgatccgcgcgtatggctgcgcgctgcacagacgtccatgatcacccgtctggagcaggctttcaaagaactgaacgcggttgacgttctgtaatctgaaataagctgggcaaatggcttcccccgggaagccatttttatttgcgggttattattccgctttaaaacattcatcacatttattcatccgctaattgtgagtcaaggcacataacctgccatgtgggataagtatgatcgttgtcgttgcgttgaaaataataatgaagctattgcaaacacaataaccataatgagtcgcgagggtattcaggcgaatatctccgtaaaacgtaaattacagcgcgctgtaatttatctctggttattgcgaggaaaggatgcacattcaacacgatctgcccgtcactattgacgatattttagacgctaaggaaaggctcgccggacatatctacaaaaccgggatgccacgctcaaattacctcagtgaatgctgccacggcgaaatctatttaaaatttgaaaatatgcagcgtaccggctcgtttaaaatacgcggtgcgttcaacaaactcagttcgcttaccgacgaggaacgtcagcgcggggtggtagcctgttccgccggtaatcatgcgcagggtgtctccctatcctgcgccatgcttggtatcaacggcaaagtggtgatgcccgtcagcgcgccgaaatcgaaagtcgccgccaccagcgattattccgcccaggtggtgatgcatggggagaattttaacgacaccatcgccaaagtcagtgaaattgtcgaaatggaaggacgtattttcattccgccttacaacgacgaaaaggtcatcgccgggcaggggacgatcggccttgagattttagaagatctctatgatgtcgataacgtcattttaccggtcggcggcggcggtttaattgccggggtcgcgctggctatcaaatcaattaacccaaccatcaatattatcggcgtgcaggcggaaaatgtgcacggtatgacggcctcgtttcgcgccgggaaaataaccagccatcgcaccacaggtacgctggcggacggctgcgacgtctcacgtcccggcgatttaacctttgagatcgtcaatgcattagtctcagatatgattctggtgagcgaagaagaaattcggcacagcatgttagcgctgatccagcgtaataagattatcgccgaaggggcaggggcgctggccaccgccgcattattaagcggcaagctcgacgatattatcaaaggccgaaaaaccgtcagccttatttccggcgggaatatcgatctctcgcgggtctccgctattaccggcgccggtgaattctgaaggtataaaaaggatattttatgagcacaactgacagcaccattctcagccagcaggacaaagcgctatggcgtaaatccgacaccacctggacgctgggattattcggcacggccattggcgcaggggtattattcttcccgatccgcgccggattcggcggcttgatccctattctctgtatgctgctgctggcgtacccgattgcctttttctgccaccgcgcgctggcccggctgtgcctgtccggcagcaaggtatcgggcaatattaccgaaacggtggaagagcacttcggcaggaccggcggcgtggtgatcacctttctctacttcttcgccatctgcccgctgctgtggatttacggcgttaccattaccaacacctttatgaccttctgggaaaatcagctccagctgatgccgctaaaccgtggcctggtggcgctggcgctgctgctgttaatggcggtggtgatctgcttcggtaaggatctgatggtcagggtgatgagctggctggtatttccgtttatcgcaagcctggtactgatctccctgtcgctgatcccctactggaacagcgcggtgtttgaccaggttaacctgagcgagatttcgctggccggtcatgacggtattctggtgacggtgtggctcggtatctccattatggtgttctcctttaacttctcgcccattgtctcctctttcgtggtctccaaacgcgaggagtatgaagcggattttggccgggattttactgaacgcaaatgtgcacaaattatctcccgcgccagcgtgctgatggtggcggtggtgatgtttttcgccttcagctgcctgtttaccctgtcgccgcaggatatggcggacgccaaagcgcaaaatattccggtgctctcttatctggcaaaccacttcgccgccatgagcggcagtaaatccacctttgccaccgtgctggagtatggcgcgtccattattgcgctggtggctatttttaaatccttctttggccattaccttggcaccctggaagggctgaacggcctggtagtcaagtttgcttacaaaggcgataaaacccgcgtctccaccggcaagctgaataccatcagcatgctgtttatcatgggttccacctggattgtggcctatgcgaatccgaatattctcgatctgatcgaagccatgggcgcgcctattatcgcttcgctgctgtgtttattgccgatgtatgccgtgcgcaaagtcccgcagcttgcgaaatatcagggcaaagccgacaacctgttcgttaccctgatcggcctgctgaccattctcaacatcctctacaaactattttgatcggctaaaaatgccacgacggagagggaaacctctccgttaatccgttgaaatctggcagatgatcttttttatggttaccctttgttgacctgtctcacgcctgcaacgtgagtgttacgccgttttggcaagaaaaaaaggaaccgtaaatggacgatcttaacgtggttggcagcatcaatagcgcagggggatggctggtacataaccaggcattactgctgagttatgcggtgaatatcgtggcggctatcgccattatcatcatcgggatgatcatcgcgcgtatcatttccaacggcctcaatcgcctgatgctggcgcgacatattgacgccaccgtggcggactttttatcggcgctggtgcgctatggcattatcgcctttacgctgattgccgcgctggggcgtgtcggggtgcaaaccgcctcggtgatcgccgtgctgggcgccgccggtctggccgttggtctggcattacaggggtcgctgtcgaacctggccgcgggcgtgctgctggtaaccttccgcccgttccgctccggcgaatatgttgatttgggcggtgtggccggtaccgtgctgcatgtgcagattttctctaccacgctgcgctctgccgatggccgctatgtggtgatcccgaacggtaaaatcatcgccgggaatatcatcaacttttcccgtgagccggtacgccgcaacgaatttatcatcggcgtggattacgacgcggatatcgatctggtgagaaaactgctgacggagatcatcgaatcggacgaccgcattcttaaagatcgcgagatgaccgttcgcatgaacgagctgggcgcctcaagcgtgaactttgtgatccgcgtctggagcaacagcggcgatctgcaaaacgtttactgggacgtgctggaacgcatcaagaaaaccttcgatgccaacggcattaacttcccgtatccgcagatggatgtgcatctgaaacgcgaaaaagcggaaaagcaggcggaagcggaagcctgacctgagcatcaatgcccggctacgttgccgggcggcgacttcgtcctgcccggcctacaggtggtaccctggccgggcagggtattattaactccacttatccccgattaaaataatccatttccgctaataactgccgcccggtatagtcggcgcattccttattagcgtgagtaattccaggtgttaacttattatattcaggggcttgccctcggcgcggctatgattttacccctcggcccgcaaaatgcgtttgtcatgaatcagggcattcgccgccaccatcatttgctggtcgcctcgctgtgcgcggtgagcgatttgctgctgatttgtgccgggatctttggcggcagcgcattgctgatgcagtcgccgtggctgctggccatcgtcacctggggcggcgtggcgttcttgctgtggtacggctttggcgcgctgaaaacggcgctcggcagccagccagagcttgccagtggggaagtatcaaaacagggccgcgggcggatcatcgccaccatgctggcggtcacctggcttaatccccatgtctatctcgataccttcgtggtgctcggcagcctgggcgggcaactggccgaaatgccgaaacgctggtttgcgctcggcaccatcagcgcctccttcctgtggtttttcagcctggcgctgctggcggcctggctcgccccgcgtctgcgtaccgccactgcccagcgcattattaatacgctggtgggtggtgtgatgtggttcattgcctttcagctggcccgcgaaggtgtccatcacttacaggcgctgtggtaatcagaccataccttatggacaagcgtgctgaaaacgctaagcttgctggcagaagcctgtatttttgggcgattgtcatgacatggaggaactacagtgaagtttaacgttatagccctggcagcaatggttggattaggtgcgatgtcggtacaggcaagcgaattgccgaacgggccgcacatcgttacttcaggcacggcgagcgtcgatgcggttccggatattgccaccctggcaattgaggtcaacgtagcggccaaggatgccgcctctgccaagaaacaggcagacgatcgcgtggcgcagtatttaggcttcctcgagaaaaacggcgttgccaaaaaagacatcaactccgccaacctgcgcactcagccggattacgactatcaggacggcaaaagcattctgaaaggctaccgcgcggtacgcagcgtggaagtgaccctgcacgagctggataaacttaactccctgctggatggcgcgctgaaagcgggcctgaacgaagtacgttcagtcaccctgggcgtggcgcagccggaagagtacaaagacaaagcgcgtaaagcggccattgacgatgcgaagcatcaggctgaacagctggcggcaggctttaacagcaagctcggccaggtgtacagcgtgcgctaccacgtttccaactatcagccgaccccgatggtccgcatgatgaaagcggatgccgccccggtatcagcccaggaaacctacgagcagccgaccattcagtttgacgatcaggtcgacgtggtgtttgaactgcaaccgggcgcaaacgcggcaccggcacagtccacgccagccagccagccggctccggcagcgcagtaaggttggtggtgtgcccggcggcgctgcgcttgccgggcctacgacagtacgacagtaggccgggtaagcgccagcgccacccggcagttgcgccacaatactttaatcctgacgcaatacccgatgaccgtgcgctaacagcgcatcggtgacgttgcgcatcatgcggctttccggcgcaaagcggtgccagtagagcatccggcgctggaacaggcccggcgtgagatcaatcagctcaccgctgtctaactctctttcaatctgcaaatgcgggatcatgcaacaggtggtgccctgacgcgccagctgcacgaaggcttctgacgagttcacgatatggcagggcacgctgcccggcggcaggtcgaaattctgctgtaaaaacgcctgatgcatatcatccagatggtcgaacgccacggcaggcgctttcagcaaggcctggcgggttacgccgttcggaaaatagcgctcagcaaaggctttcgagccgacaaacaggtaatcgagcgcacccagttggtccaccaggcagcttggcaatgcctgcggttgaatggagaccgcgcccaccacttcgccacgtcgcagccgctcctgggtgcgggtttcatcttccacctgtaaattcaggcggatcggcgaatcggccagcaccggggccagcgccggtagcaaccaggtcgccagactgtcggcgttgaccgccagcgacagcagcaacggcgtggaaccgatctgctcatccccgagccactcctcttccagcagttctacctgacgcagcaacgccagcagtttttgcccctgttcggtcgggcgcggcggcacggtacgcaccagcagcggctgaccaaacatgttctcaagctgtttaatgcgctgagaaacggcggactgagtgatacacagcttttgcgcggcgcgctcgaagccacgctcccggatgaccgcgtcaagcgcctgtaatgttctgtagtcaggacgtttcattgctataacttatccccgtttgtgattaggcgcactatgacataattttgtcgtcctggcgggatgcatttataatgcgggcaggattttctcaccacaggccaatgatcatgacgcaggatgaactgaaaaaagcagttggatgggcggcgctcaaatacgttgaacccggcactatcgtgggtgtgggcaccggctccacggcggcgcattttattgacgcgcttggcaccatgaaaggccagatcgaaggcgcggtatccagctccgatgcctccaccgccaaactgcaaagtctcggcattcacgtttttgatctcaacgaagtggaccgtctgggcgtgtacgttgacggcgctgacgagatcaacggtcagatgcagatgatcaaaggcggtggcgcggccctgacccgcgagaaaattatcgcctcggtggccgacaaatttatctgcatcgccgatgcctccaaagaagtggcgatcctcggcgcattcccgctgccggttgaggtgatcccgatggcgcgcagcgccgtggcgcgtgagctggtcaagctgggcggacgtccggaataccgtcagggcgtggtgaccgataacggcaacgtgatcctcgacgtgcacggcctggagatcatcgatcccatcgcgctggaaaacgccatcaacggcctgccgggtgtggtgacggtcgggctgttcgccaaccgtggcgcggatgtcgcgctgattggcaccgccgacggcgtgaaaaccatcgtaaaatgatctggcggggagcctgccttcccgttaaaaaaattttgcgtgacagattttggtgacatctatcacgttttttattccgctctgattttccttccgcaatcgttttcttttccagcattttcctctgccaaattccgctgtatgacttttcttcagagcgccgccgcaaaggttcatattgctgcaatagttttttttgatatgttggctaaggcgaacacacacataagttatgacaaacagggtcggggaaatggcaaaagtatcactggaaaaagacaaaattaagtttctgctggtggaaggggtgcatcaaaaagcaatcgatagcctccgcgccgcgggttacactaacatcgaattccacaaaggggcgctggacagcgaacagctgaaagcctccatccgtgatgcgcatttcatcggcctgcgatcccgtaccaacctgacggaagagattttcgcggcggcagaaaaacttgtcgccgtgggctgcttctgtatcggcaccaaccaggtggatctgaacgcggcggcaaaacgcggcattccggtgtttaacgcgcccttctcaaatacccgctcggtagcggagctggtgatcggcgagctgttgctgctgatgcgcggcattccggaagcgaacgccaaagcgcaccgcggtatctggaacaagctggcgaccggctcctatgaagcgcgcggcaaaaagctggggattatcggctacggccatatcggcacgcagctggggatcctcgcggaatcgctggggatgcacgtctttttctacgacattgaaagcaagctgccgctcggcaacgcgacccaggttcagcatctctccgacctgctgaacatgagcgacgtggtaagcctgcacgtaccggaaaacgcctccaccaaagatatgatgggcgcggaacagctggcgctgatgaaaccgggttcgctgctgatcaacgccgcacgcggcacggtggtggatattccggcattatgcgaagcgctgcgcagcaaacatctggcgggggcggcaatcgacgtcttcccgacggaaccggccaccaacagcgatccgttcaactctccgctgtgtgaattcgataacgtgctgttgacgccgcacatcggcggttccacccaggaagcgcaggaaaatatcggcctcgaagtggcgggcaaactggtgaaatactccgataacggctccacgctgtcggcggtgaacttcccggaagtatccctgccgctgcacggcggtcgtcgcctgctgcacatccatgaaaaccgtcctggcgtgctgaccgcgatcaaccagatttttgccgagcagggcgtgaacatcgccgcgcagtatctgcaaacctcgccgcaaatgggctatgtggtcattgatattgaagcggaagaggatgtggcagagaaagcgctgcacagcatgaaggccattccgggcaccatccgcgcccgactgctgtactgattttccctcacactgaccctctccccagggagaggggttaccacatccagactttcgacggcgtcaccaccgccggcagcggcacatcccactcttccaccggcagtttctccacaaactgacaatcatgggcgtaacccaccggcgtcagcgcgtactgttgccagttttgcagcgtgcggtcgtaaaagccacctcccatgcccagccgctgcccctgcgcgtcaaaggccaccagcggcgtgatcagcacatccagcttgctgagcggcagcacgtcgcgcacatccagcctcggctcataaattttcaaccggttcatcaccagatcgctttgcggatggtaatgcaaaaacagcagattgccggggctgaaagggtgcagtacgggcagatagacctgtttgccgctgcgccacagctgttcgataagcggacgggtatccagctcgccatcaaaggacaaaaacagcgcgacggtgcgggccatcaccacgggcggaaacgccatcatgcgggaggcggcctgttcggcaaagcgtaattgttgatcggtggtcaatgcgcgacggcgcagacgaatttgctggcgaatggtctgacggggtgaaaccgggagtgttgtttgcgtcatgataacggctggtacaggtagtggtagaagaaggggaatctccgagatgccgccgcaggctgtaacccttgaacccttggttcaaggtgaatgtgtcgtcacagttttaaggcttctcggacgaaccgagcatgctcaccaaccgtggagcgccacattcttgtggtatgaaatatcggctcaggggactggcccgcttgcgaacatctcagagaaattttttcttcatggtcactctaccatagtagaccctgaagtgttattcaaacttcggccccggtctttctgttatgcgaccctgatcaagcaatgcctgttcgatggtctgctgtaacatccgaatacgctgctccatgttggcggcgtagtcgcgggtttttgccttttcctgagcaagttcgtagctgatgttcaacgcggcgatgaaaaccagctgctcagtatttgtgactctagtgcgtactttcagatcttgcaaccgctgattcagatcttccgcagcctgattcaaagcatccctttgttcaggtgggcaattcactcgcagtgaacggccaaaaatttggatatcgacgggttctgcagacatgccaccttcctgctgtttgactgcgctctgccttcccagccgagccctggctgcgaaggggcgtcactatagctaccctgatgagaggattcaagccctttaacggcacaaatacattgcctgaggtaaggcctgacgggtatatcaccagggtccaaagtggtagcataccatgaatattcctcccaacgacgacgaatgcgcatgtcaatacagaacgaaatgcctggttacaatgaacttaaccagttactcaatcaacagggcgttggcttaaccgcggcggaaatgcacggtctgatcggcgggatgctctgcggcggcaacaaagacgcctcctggcagccgctgttgcacgacctgacaaacgaaggcctggcctttgggcatgagctggcggaagccttgcgcaagctgcatgccgccaccagcgacgcgctggaagacgatggtttccagttccagctgtttctgccggatggcgacgacaccacggttttcgaacgtgccgacgccatggcgggctgggtcaaccacttcctgcttggtctgggcgtcactcagccgaagctggataaagtgaccggcgaaaccggcgaggcgattgacgatctgcgcaacatcgcgcagctgggctacgaagaagacgaagatcaggaagagctggagatgtcgctggaagagatcgtcgagtatgtgcgcatcgccgcgctgctgtgccacgatacgttcacccgaccacagccaaccgcaccggaaatgcgtaagcccacgctacactaaactgtcttgttgaatatggaggtgtcatgacacagcttgaatttcttcgtcgccgtcaggccttactggcgcagatggcgcctgccagcgcggctctaatcttcgccgcgccggaagtgacccgcagcgccgacagtgaatatccctaccggcagagcagcgacttctggtatttcaccggctttaacgagccgcaggccgtgctggtgctgattaaaagcgatgacacccataaccacagcgtgctgtttaaccgcctgcgcgataaaaccgccgagatctggtttggccgccgtctcgggcaggaagccgccccggaaaaactgggcgtcgatcgcgcgctggcgttcagcgaaatcaacgagcaactctatcagttactgaacggcctcgacgtggtctatcacgcgcagggcgaatacgcctgggccgatgagatcgtctttgccgcgctggataaactgcgtaaaagcgcgcgccagaacctcaccgcgccagccaccatgaccgactggcgtccgatggtgcacgaaatgcgcctgttcaaatccgccgaagagatcgaggtgatgcgtcgcgccggagagatcaccgccctggcgcacacccgcgccatgcaggtctgccgtccggggatgttcgaataccagctggaaggcgaaattctgcacgaattttcccgccacggcgcgcgcttcccgtcctacaacaccatcgtcggcagcggtgaaaacgcctgcatcctgcactacaccgaaaacgaaagtgaaatgcgcgacggcgatctggtgctgattgacgctggatgcgaataccagggctacgcgggcgacattacccgtaccttcccggtaaacggcaaattcacccccgcccagcgcgccatctatgacatcgtgctggaatctttagagacggccctgcaacgcttccggccgggcgtctccattcaggacgtgactgccgacgtggtgcgcatcatgatcaccggcctggtgaagctcggcatcctgaaaggcgaaatcgaccagctgattgccgacaacgcgcaccgtccgttctttatgcatggcctgagccactggctggggctggatgtgcatgacgtcggcgtttacggcgcggatcgctcccgcgtgctggagccgggcatggtgatcaccgtcgagccgggtctgtacatcgccccggacgccgacgtgccggaagaataccgcggcattggcgtgcgtattgaagacgatattctgatcactgaagacggcaacgaaaacctcaccgccagcgtggttaaaaaagccgatgacatcgaggcgctgatggcggcagcgaaacgcgcatgagcgtgattatcgtgggcggcggcatggcgggcgcgaccctggcgctggccatttcacgcttatcaaagggaacgctgccggtgcatgtggtggaagccatcgccccggacgccacgcgccatccggggtttgatgcccgcgccattgcgctggcggagggcacctgtcagcagctggcgcgggtcggtatctggcaacgccttgccgactgcgctacacctattaccaccgtacacgtcagcgatcgcggccatgcgggttttgtcactttagaggcccaggattatcgcgtggacgcgctgggtcaggtggtcgagctgcatgatatcggccagcgcctttttgccatgctgaaaaacgcccccggcgtgacgctgcattgtcccgcacgggtcaataccttttcccgcacggaaaacggcgtcagcgtgatgctggaaaatggcgatcagatcgacggcacgctgctggtagccgcggatggctcccgttcgtcgctgggatcgcaaagcggcattacctggcagcagacgccctatcatcaggtggcggtgatcgccaacgtcacggtgtctgcgaaacaagctggccgcgccttcgagcgctttaccgagcatggcccgctggcactgctgccgatgacgcaggggcgctactcgctggtgtggtgccacgcagaaaacaagcgtgacgaggtgctcgcctggtctgacgaaaaattctgtcacgagctgcaaaaagccttcggctggcggctcgggcgtatccttcacgccggaacgcgcagcgcctatccgctgtcgctgaccaccgcctcgtcgtccatttcccatcgcgtggtgctggtgggcaatgccgcccagacgctgcatcctatcgccgggcaggggtttaacctcggcatgcgcgacgtgatgacgctggccgaaaccctgaccagcgcatgggcgagtcagacggacgtaggcatctatccggtgctgtgccagtatcaaaaacgccgccaggccgacaaagaggcgaccatcggcgtcaccgacgggctggtgcacctgttcgccaaccgctgggcaccgctggtcgccgggcgcaacgccggtctgatggcaatggaattatttaccccggcacgtgatgtgctggcgcagaggacgctgggctgggtcgcgcgctaggcctgtcttaccaggctattttatttgccattttgaacctgggcagtgctcaaaatcctcacgtactgcaagtacgctccggtttttccgcgctgtccgtgttcaaactggctgcaacaattacgcctgctaagccaggctgctggagtgaattgtgcaaagtgtagatgtagcaattgttggcgggggcatggtcgggctggctgtggcctgtggattacagggcagcgggctacgcgtggcggtgctggaacagaatgcgccggtgccgctggccccggatgcgccgcctgaactgcgcgtatccgccatcaacgccgccagtgaaaaactgctgacgcatctgggcgtctggtctgacattctggcgcaccgcgtcagctgctatcacggcatggaagtgtgggacaaagacagctttggccgcatcgcctttgacgacgaaagcatgggctacagccatctgggacacatcgtcgaaaacgccgtggtacatcaggcgctgtggcaaaaagcgcagcagagcagcgacatcacgttgattaccccggccacgctgcaacaggtcgcctggggcgaaaacgacgccttccttaccatgcaggacggcagcatgctgacggcgcggctggtggtgggcgctgacggcgctaactcctggctgcgtagcaaagccgatattccgctcacttactgggattacggccatcacgcgctggtggcgaccatccgtaccaccgagccgcacaacgccaccgcgcgtcaggtgttttacggcgacggcattctggcattcctgccgctggcggatccgcatctgtgctctattgtctggtcgttgccaccgcgtgaggcggaaaaaatgcagcaggccagcactgaagacttcaatcaggcgctgtgcgtggccttcgacaatgcccttggcctgtgtcaggtggagagcgagcgtcaggtttatccccttaccggacgctacgcccgtcagtttgccggccaccgtctggcgctggttggcgacgcggcgcacaccattcatccgctggccgggcagggcgtcaacctgggctttatggatgcggcagtgctggttaacgagctgcgtcgtctgcatcgcgagggcaaagacatcgggcagcatctctatctgcgccgttacgagcgcagccgcaagcacagcgcggcggtgatgctcgccgggatgcagggcttccgtgggctgtttgccggtaacaacccggcgaaaaaattgctgcgtgatattggtctcaagctggccgacaccctccctggcgtgaagccgcaacttatccgtcaggcgatgggtctcaacgaccttcccgactggctgaaataatcattttttagccttccgcctgaactaagatccgcgtcacactttcccttcccggttccgggaagggcagcgtcacctcatttgaaataatctaatttcacccgctttttcagattactttttctcatgtcatgaattttcagcgtcgggaaattctcatgatttttggtgaaaaatgtcactttacagggtcgggaagttcaattctccctataaagagaatgttaattactcgttattaagttttttacgctgtgcggctctgcgggttttcaggtcataagctaatgtgatggcgcatttttacttatggtttagggcgcttttcagtgataagttcaggcgaaaggtaacgtttgcgtcggcaacctgaaaggaggctgacgccgggggtcgtggcggtttttatgacccgggaaatccttaacagccccgcttattcaatgaggaaaagatggctcagcagactcctttgtttgaacaacacacgctatgtggcgcgcgcatggtggatttccacggctggatgatgccgctgcattacggctcccagcttgacgagcatcacgcggtacgccgcgatgcaggcatgttcgatgtgtcccacatgaccatcgtcgatctgaaaggcacccgtacccgcgacttcctgcgttacctgctggccaacgacgtagccagactcaccacccccggcaaggcgctctacagcggcatgcttaacgcctccggcggcgtgattgacgacctgatcgtctacttcttcagcgaagacttcttccgcctggtggtcaactccgccacccgcgaaaaagatctcgcctggatcaccgaacacgccgcgccttacgccatcgacatcagcgtgcgcgacgatctatcgctgatcgccgtgcagggcccgaacgccaaagccaaagccgccacgctgttcagcgatgaacaacgtgaagccgtcagcggcatgaagccattctttggcgtggaaacaggcggactctttattgccaccactggctacaccggcgaagcgggctatgaaatcgccatgccgaatgaaaaggccgccgaattctggcatgcgctggtggaagcgggcgtgaaaccctgcggcctgggcgcgcgcgatacgctgcgtctggaagcgggcatgaatctttacggtcaggaaatggatgaaggcgtctctccgctggccgccaatatgggctggaccatcgcctgggaacccgctgaccgcgactttattggccgcgacgcgctggaagcgcagcgtgaaaatggcaccgaacagctggtcggcctggtgatgaccgaaaaaggcgtgctgcgtaacgaactgccggtgcgtttcactgaccacgacggcaatcagcaggaaggcgttatcaccagcggtaccttctcaccgacgctgggctacagcattgcgctggcccgcgtaccggcaggcattggcgaaaccgccatcgtacagatccgtaaccgcgaaatgccggttaccgttaccaaacctgtttttgtgcgcatgggtaaacctgtcgcgtaacgcattttattgtggagaaacctttatgagcaatgtaccggctgaactgaaatacagtaaagaacatgaatggctgcgcaaagaagcggacggcagctacaccgttggcattaccgagcacgcgcaggagctgctgggtgatatggtgtttgtcgatctgcctgaagtgggcgcgaccgtcagcgcgggcgacgactgtgccgttgccgaatccgtaaaagccgcttccgatatttatgcgccggtcagcggcgagatcctggccgtcaacgacgcgctgagcgacacgccggagctggtcaacagcgagccgtacagcggcggctggatcttcaaaatcaaagccagcgatgaaagcgaagttgccgctctgctggacgccagcgcgtatgaagcgctgttagaagacgagtaaatatttcattactttgcaggcccggtgagcgccagcgccaccgggcaaatcagccagaccgtttcaggaaccctcgcccatgacacagacgctaagccagcttgaaaatagcggcgcattcattgaacgccacatcggaccggatgccacgcagcagcaggaaatgctgaacgccgtgggcgcagagtcccttaacgcgctgatcggccagattgtgccgaaagatattcagctggataccccgccgcaggtgggtgacgccgcaaccgaatttgccgcgctggcagagttaaaagccatcgccgcccgcaataaacgctttaagtcttatatcggcatgggttacaccgccgtgcagctgccgccggtgatcctgcgcaacatgctggaaaatccgggctggtataccgcttataccccgtatcagccggaagtttcccagggccgtctggaagcgctgcttaacttccagcaggtgaccctggatctgaccggactggacattgcctccgcctcgctgctcgatgaagccaccgcaggcgcggaagccatggcaatggcaaagcgcgtcagcaaactgaaaaacgccaaccgtttcttcgtggcggcagacgtacacccgcagacgctggacgtggtacgtacccgtgctgaaacctttggttttgacgtgatcgtcgatgatgctgacaaagtgctcgatcatcaggatgtgttcggcgtgctgttacagcaggtgggcaccaccggcgaagtgcatgactacagcgcgctgatcgccgaactgaaagcgcgcaaagtgattgtcagcgtagccgccgactttatggcgctggtgctgttaaccgcgccgggcaaacagggcgcggacatcgtcttcggctctgctcagcgtttcggcgtgcctatgggctacggcggcccgcacgcggccttcttcgctgcgaaagatgaattcaaacgttccatgccaggccgtattatcggcgtgtccaaagatgccgccggtaacaccgcgctgcgcatggcgatgcagacccgcgagcagcatatccgccgcgagaaagcgaactccaacatctgtacctcgcaggtgttgctggcgaacattgccagcctgtacgccgtgtatcacggtccggtcggcctgaagcgtattgccagtcgtattcaccgcctggcggatattctggcggcgggcctgcaacagcacggcctgaaactgcgccacgcccactacttcgacaccctgtgcgtggaagtggcggataaagccgaagtgctggcgcgtgctgaagcccgtgaaatcaacctgcgcagcgacatcattaacgcggtcggcattacgctggatgaaaccaccacccgcgaagacgtgcagctgttgcttgccgtgctcaccggcgttgagcagcacgacattgacgcgctggataaaaacgtcgctcacgacagccgttccattcagccggctatgctgcgcgaagacgcgatcctcgcgcatccggtgtttaaccgctatcacagcgaaaccgaaatgatgcgctacatgcacagtctggagcgcaaagatctggcccttaaccaggcgatgatcccgctcggctcctgcaccatgaagctgaacgccgcggccgaaatgatccccatcacctggccggaattctcggaactgcacccgttctgcccgccggagcaggcggaaggctatcaccagatgatcaaccagctctccgactggctggtcaaactcaccggttacgatgccttgtgtatgcagccgaactccggcgcgcagggcgaatatgccggtctgctggcgatccgtcactatcacgaaagccgtaacgaagggcatcgcgatatttgcctgatcccgagctccgcgcacggtactaacccggcgtcggcacagatggcggggatgcaggtcgtggttgtggcctgtgataaaaacggcaacatcgatctgaacgatttgcgcgccaaagcagagcaggcgggcgacaatctctcctgcattatggtgacctacccgtccacccacggcgtgtatgaagagaccatccgcgaagtctgcgagatcgtgcaccagttcggcggccaggtgtatctggatggcgcgaacatgaacgcccaggtgggcattacctcgccgggctttatcggcgcggatgtgtcgcaccttaacctgcataaaaccttctgcattccgcacggcggcggcggtcctggcatggggccgatcggcgtgaaagcgcatctggcaccttttgtaccgggacacagcgtggtgcaaatcgaagggatgctgacccgtcagggcgcggtatccgcggccccgttcggcagcgcctctattctgccgatcagctggatgtatatccgcatgatgggcgcggaagggctgaaaaaggcaagccaggtggcgatcctcaatgccaactacatcgccagccgtctgaaagacgcctatcctgtgttgtacaccggtcgcgacggtcgtgtggcgcacgaatgtattctggatattcgtccgctgaaagaagagaccggtatcagcgagctggacatcgccaagcgcctgatcgactacggtttccatgcgccgactatgtccttcccggtggcgggcacgctgatggttgagccgacagaatccgaaagcaaagtcgaactggaccgctttattgatgcgatgctggcgatccgtggggaaatcgaccgcgtgcaggccggtgagtggacgctggaagataacccgctggtcaacgcgccgcacacccagcgcgagctggtggcggagtggcagcacggttacagccgcgagcaggcggtcttcccggcagggctgaacaacaaatactggccgaccgtgaagcgtcttgacgacgtgtacggcgaccgcaatctgttctgctcctgcgtgccgatgagcgactatgagtaattgatccgttctgttctgtaggccgggtaagcgtcagcgccacccggctttttttatgaggaaaacgtaatggcaatagcactggttaccggcggcagccgcgggatcggcaaagcaacggcgctgcaactggcgcgcgagggttataccgtggcggtgaactatcaccacaatattcaggccgccaccgacgtggttaacgagatcgtcgcagcaggcggcaacgcctttgcgctgcgggcggacatcagcgatgaagcgcaggtgctggcgatgtttgagagtatcgatcgggaaggcgcgcctctgaccgcgctggtgaataacgcgggcattttgtttgaacagagcactatcgaaaacctgagtgccgaacgcatcaaccgcgtccttgcgaccaacgtcaccggctattttctttgctgtcgcgaggcggtaaaacgtatgtcccataagcacggcggggcaggcggtgctattgtcaacgtctcttccgccgcatcacgcctgggcgctgcgggtgagtatgtggattatgccgcctcgaaaggggcagtagatacgctgacgaccggcctggcgctggaagtggcggcgcaggggatccgcgtgaactgtgtacggccgggttttatctacacggagatgcatgccgacggcggcgagccggggcgcgtggatcgggtgaagacggtattaccaatgcagcgcggcggccagcccgaagaagtggcgcaggcgatagtctggctattgagtgaaaaggcgtcctatgtgacgggaagttttcttgagctggcgggcgggaaataaacaggccctgaacgcgtgtaggccgggtaagcgtcagcgccacccggcaaaatgaagccttgtaggccgggtaagcgcaagcgccacccggcaactgtcaacctcagagattctcgccgttgctggcgatcacttctttgtaccagttaaagctcttcttacgggaacgggacatgtcgccggtgccgtcgtcgtgcttattcacataaataaagccatagcgcttgctgtactgcccggtagtgaaggacacacagtcgatgcagccccacggggtatagcccatcagatccacaccgtcataagtcaccgctttgaccatctcttccacgtgcgcccgcagatagtcgatgcggtaatcgtcgttgatgctgccgtcttcttccactttgtcgtaagcgccaaagccgttttccacgatgaacagcggtttctggtaacgctcatagagttcgcacagcgcatagcgcaggccaaccgggtcaatctgccagccccagtcggaggccttcacgtgcgggttcggcacgctgccctggaaaccggagatcgcatcgccgctgccgccttcttctttcacggcgttggtcatgtagtagctgaagcccagataatcgcaggtgccttcacgcaggatctgctcatcgcccgcttccattttgatgttgaattcccggcgttcccactcgttcaggacataggatgggtagtagccgcgcagctgcacgtcggtaaagacataacgctcacgcatggattcctgggcatacattacatcttccggcttacaggagaacgggtacagcggcaccatcgccagcatacagccgattttcatctccggattaatgcgatgaccaatcttcaccgccatggcgctggctacgaactggtgatgcagcacctggtacatggtctcttccggattatcatgctcggtatagaccacgccggagcagcagtagccgaacagcggcgcgcgccagttacgctggttgttgatctcgttaaaggtcatccagtatttaactttgttcttatagcgctcgaataccacttccgagaaacgcacaaagaaatccaccactttacggttggtccagccgccgtattcctgcaccagatgcaatggcatttcaaagtgggagagggtgatcaccggctcaatgttgtatttgagcagctcatcaaacatgtcgtcgtaaaactgcaggccttcttcgttcggctcggcctcatcgcctttcgggaagatgcgtgtccaggcgatggaggtgcggaagcatttgaagcccatctcggcaaacagcttgatgtcttctttatagtggctgtaaaactccaccgcttcgtggttcgggtagtatttgcccggcaccacttcgctggtgatctcgcgcggtacgccgtgcgcgccgccggtcagcacgtcacaaatgctcgggcctttgccgcctttgttccagccgccttcaacctgatgcgccgcaaccgcgccgccccataaaaagtctttcggtaatgtcagctttttcatcgatcattttctcttgtgtgcagtaaataaaggttaccgggcagtttcactctgaaaatgagtctaacaaagggcggagaaatgtcacgatataacaaatcaccgctacggtgacttgttacatggaaaaaacagcctgtttttttatgctaatttcttcgccagtttacggcctaaggattcgagaatataaattaccgggatttgcgtggtgacatcataaaccccggcgatacgcatttgcggcgcatgccaggagatattgaaatccgccagtttcgccagccgcgaatgctcatggctggtgatggtcatcactttacagttatgcaggctgaactggctggcgaagcgcaggatctcttcagtttcaccggacaccgacagcacgatagccagcgcgtttttcgccatgtcgttagtcaccggaaaataaggatcgtcaatatggttgctgaattttccgatattggaaaagaatcgtgcgccatatttagcaagcgacccagaagtgcctgcgccgacaaaaataatacgctcggaagcgaaaataatatcaaccgcctgatccagaagcgtatcaaattcatcgttattcacgcttttaaaaaagctgataatttccccggcgccaaaattagcctgcggcggttcgttctgctctaaatataatttatagcgcacgcgaaattccgaatagccttcgcaattcagcttgcggcagaagcgcagtacggtggtggtggagacgccagcagcgtcggccagctcgcgaatggtcatgtacatcaccttgtcgcgattcttgatgacgtagtgataaaccatcatctcaagattattgaggctggcgacagcggagtgagtaaacagggtcacgggcttgcaggatcctttccgggcaactgaacggctctatgctgccacaaaacggacaaaacaggaatcgcataacgccgggtgcagtcaccgggaaaaatgaacaactgtaaacttaacaatgcccgcaatgcctggaagcgaagcggctggaaatatattttagcgaacaggtgtgcactggaatcattctcagttactctggtgaggtcatcgtcagtgtcgcgcgtttgtcatcatcgtgcgtcagaatggcgatgagtaacctttgtttcctggagtacgccaatggttgaaaaaccgcttatcacgaagggatattcagtggctgaggaagtagccaacagcatcagtcacggcatcgggctggtgtttgggatcgtcggcctggtactgctgctggtacaggcagttgataacaacgccagcgccaccgccatcaccagcttcagcgtttacggcagcagtatgattgtgctgtatctggcctccacgctgtaccacgccattccgcatccgcgggctaaagtctggttaaagaaatttgaccactgcgccatctatttattaatcgccggcacctataccccatttttactggtcgggctggattcaccgctggcgcgggggctgatgattgttatctggagcctggcgctgctggggatcctgtttaagctgaccattgcgcaccgctttgaggtgctgtcgctaattacctatctggcgatgggctggctgtcgctggtggtgatttatgaaatggtgatgaagctggccgttggcagcgtaacgctgctggccgtgggcggcctggtgtatacgctgggggtgatcttttacgcctgccagcgcattccgtataaccacgctatctggcacggctttgtactgggcggcagcgtctgccactttctggcaatttatttgtatatcggcacagtgtaattactgccggaaaggcaatgtatgcccggcaagcaacgcgccgccgggccaaccagcctggatcaggcttcttctaacgagtagggcagcggctcgatggccagcgtaaagctgtcatcgcgcacacggaacacgctgtccggctccatatcgttattcatcactacctgcaccagcaaacgcccgtcttccagctgagcggcggcgagcaccgtgccggttctgcgccagttttcacccagtttcatttccagatcttcaccggcttccggtacccggctggctttgcccgccagataccacattgcgcgcttattcgcgccgcggaatttcgcccgcgctaccatctcctggccggtatagcagccttttttaaagctgatgccgcccagcgcctgaatattggtagcctgcggcaggaactgcgcactgttggcggcatcgatcaccggcagaccggcctcaatgttcagcgccagccactgctgactgttattaagctgcgcttcgccgcgcagggtttcggtgatgcgctccgcggtggcgacatcggttaccagcaggaagcgctccgccggttgctcaaaccacagaatttgcgtgtcgccatcctgcaccacctgcgtttgctgatcgggcagggtggagaacaggttcgccagcgccgcgcgggcctggaatccggccacgccaagcagcacgtgttcgtcatcggcggcaatggtgaccttcgagaagacggcatattttttcagctcggtcagctgcgcctcgcggacgctgcgacgttcaacccacgcaaagccatcgttacgacggaacaggcgcaggttgctccacattttgcctttggcatcgcaatgggcaaccagcagatgctgatgttcagtgagttgcgccacgtcgttagtgacctggccctgcaaatatttttcgctgtcggcaccggtgatcgtggccagcgcccagtcatcgagcgtcattagcgtcagcggcaaacgcgcagaggcgcagggcagacgcggaggaaacggagtaaaagccataatgatgtcctggtaagcttaacgctgtatgaatgcttaatgttaaaagagccgtggttcattgcaagcggtaatcgcgtggaccgcacagcttgcgagtttgcgcgcaaaaaatggtaatccttacatttttaaaggtttattctggaagcttgcttctgaagccgaacattccggtgaggattggccggaaaaagcgttacactagaagccatctttaacgtcgctatgcaggaaaagaacatggatattaccaacaaagcccgcattcactgggcgtgccgcagaggtatgcgtgaactcgacatttccatcatgcctttcttcgaacacgagtacgatacgctaagcgatgacgacaagcggctgtttatccgcctgcttgagagcgacgatccggatttattcaactggctgatgaatcacggcgaacctgcagatacggaattgcagcggatggtccagttaattcagacacggaatcgggaacgtggtcctgtggcaatctgatttacgcgtctcatggcgctcgcaatggctctctttattactgcacggtctggtggcggcgctggtgttgcttatcccctggccgttaagttatacgccgttgtggttattactgctttcgctggtggtgtttgactgcgtgcgcagccagcgccgaattaacgccagccatggtgaaattaaactcctgatggattcgcgcctgcgctggcagggcaatgaatgggatattacaggcgcgccctggttgttaaacagcggcatgatgctgcgcttacggcgcagtacggacggcaaacggcagcatttgtggctggcggcggacagtatggacgcgcaggagtggcgggagctgcgccggatgatgctccagcaaccggcgcaggaaaagcactgaggctcaggcgaagttttccgccatttcgccaagaatttgctcgcaccaggtttgcaggcgttcttcgcttaaatcgtactgattggtttcatccagcgccaggccgacaaacagctgcccgtccgcaatgacgggtttggggctggtgaactcatagccttcggtgggccagtagccgataaacttcaccgctttggcggacagtttgtcgtgcagcatgccgagggcgtcaaggaaccattcgccgtaaccgagctgatcgcccatgccgtagagggcaatcattttgccatccaggttaagggaatccagctgatcccagatggcttcccagtcttcctgcagctcgccgaaatcccatgtcgggatgccgaggatcagcacatcgtactgctccatcagtgtgggcgcgtcgtctttaaggttatgcagcgtcaccagttccgggccgataatgtcgcggattttctctgctgccatttcggtatagcaggtactggaaccataaaaaagaccaatgttcatagcgtaaacgtctcaattcctgatgtggctttgcgcacagtgtaccagaatcaatacgcaatcaggcataatgccctgacgttgaaataaggggcaatgatggaacaggatctcgcacgcatagaacaatttctcgatgccctgtggctggaacgcaatgtggctgagaacacattgagcgcctatcgtcgcgatctgcgtatgcttgtcgagtggctgcaccacagaaacagcgatgtgctcagcgtgcagcatgacgatttacaggcgctgctggccgagcgcgtcaccggcggctacaaagcgaccagctccgcccgtttactgagcgcgatgcggcgttttttccagtatctttatcgcgaaaaggtacgtactgacgatcccagcgccgttctggcatcgccaaaactgccgcagcgcctgccaaaagatctgagcgaggcgcaggtcgagcgcctgttgcaggcgccgcttaccgatcagccgctggagttacgtgacaaagccatgctggaagtgttgtatgctaccggcctgcgcgtgtcggaactggtcgggctgacaatgagcgacatcagtttgcgtcagggcgtagtgcgggtgatcggtaaaggtaacaaagaacggctggtgccgctgggggaagaagcggtctactggctggaaaactacctggagcacgggcggccctggcttttaaacggcgcgtcagtggatgtgctgtttcccagtagtcgcgcccaacaaatgacccggcagacgttctggcatcgtattaagcattatgccatccaggcgggcatagacagtgaaaagctttcgccgcacgtgttgcgacatgccttcgccacgcatctgttaaaccatggcgctgatttgcgcgtcgtacagatgctgcttgggcacagcgatctctccaccacgcaaatttatacgcatgtggcgacagaacgtttgcggcaactccatcaacagcaccacccacgcgcgtgatgctgatttattaaggatgtgaaatgaaaaaaagtttgatgatgttcaccctgctggcggcgttcagtaccgcagttcaggccgacgatgcggccattaagcagacgctggcgaagctgggcgtgcagagcacggaaattcagccatcacccatcagcggtatgaaaaccgtgctgactaacagcggcgtgctgtacgtcactgaagacggcaaacatatgatccaggggccgctgtatgacgtgagcggtccgcagccgatcaacaccaccaacagcatgctgatgacgcatctcaacgcgctggaaaaagagatgatcgtgtataaagcggcgaacgaaaaacacgtcattaccgtattcaccgacatcacctgcggctactgccataagctgcacgagcagatggcggattacaacgcgctgggcattaccgtgcgttatctggcgttcccgcgtcagggtatgcagagcgaagcggcagacaatatgaaggccatctggtgcgccaaagatcgcaacaaagcctttgacgatgcgatggcgggcaaaggtgtgaaggccgcaagctgtgatgtcgacattgccgaccagtatgcccttggcgtgcagtttggcgtgagcggcacgccggcgattgtgctgagcaatggctatgtcgtgccgggctatcaggcccctcaggagatgaaaaccttcctggacgagcataaaaaacagaccggcggtaaataattttcgtgaaacttcagagacaacttcgccgccgcgagccggatccagcggcaaatctgccggataacctgccgcccctgttacgccgtctgtatgccagccgtggcgtggtatcgcctgcggagctggagcgcggcgtaaaagggatgctgccctggcagcaactgagcggcgtggagaaggcagcggagcatctgtatcaggcgtttaagcaggggctgcgcattatggtggtcggcgattttgatgccgatggcgctaccagcaccgcgctgagcgtactggcgatgcggtcgatgggctgtccgaacgtcgcctatctggtgccgaaccgctttgatgacggttatggtttaagcccggaagtggtcgaccaggcccatgcccgtggcgcgcagctgatcctcaccgtggataacggcatctcgtcccatgcgggcgtggagcgcgcccatgaactgggtattccagtgctggtgaccgatcaccatctgcccggcgagacgctgccagatgcagaagccatcgttaacccgaatctgcgcgactgcgccttcccgtcgaaatcgctggcgggcgtcggagtggccttttacctgatgctggcgctgcgcacccatctgcgcgatcagggctggtttgaggcgcaggggatagcgatccccaatctggccgagctgctggatctggtggcgctgggtacggtagccgacgtggtgcccctggataccaacaaccgtattcttacctggcagggcttaagccggatccgcgcgggcaggtgccgtcctggcatcaaagccctgctggaagtcgcgaatcgtgacgcgcaaaaacttgcagccagcgatctgggctttgctctcggtccgcgcctgaacgccgccggacgactggatgacatgtcggtcggcgtggcattgctgctgtgcgataacgttggcgaagcccgcgtgctggccagcgaactggatgcgttaaaccagacgcgcaaagagattgaacaggggatgcaggcggaagcgctggcgctgtgcgaaaagctggagcgcagcagcgaagcccttcccggcgggctggcaatgtatcaccccgaatggcatcagggcgtggtggggattctcgcctcccgcctgaaagagcgctttaaccgcccggtgatcgcctttgcccctgcgggtgagggcctgctgaaaggttcgggtcgctctatccaggggctgcatatgcgcgatgcgctggagcggcttgatacgctctatccgggcatgatgctcaaattcggcggccacgcgatggcggccgggctgtcgctggaagtggcgcgcttcgacgagttccagcagcgctttggcgcgctggtgaccgaatggctggatccggcgctgttacagggggaaatcgtttccgacggcccgctggacgcgcaggagatgacgcttggcgtcgccgaaatgctgcgtgatgccgggccctggggacagatgttcccggaaccgctgttcgatggacgttttcgcctgctgcagcagcgcatcgttggcgaacgccatctgaaagtgatggtggagccggtcggcggcggcccgctgctggacggcatcgcctttaacgtcgacaccagcatctggccggataacggcgtgcgggaagtgagcctcgcctataaactggatgtaaatgagtttcgcggcaatcgcagcgttcagctgattatcgacgacatctggccaatttagcgccagtattcgctataaaacagggcgtaattccggtagaattccgcccttataaccgcattttgacaagtccaataaaagaaaacagaccatgtttgaaatcaatccggtaaaaaaccgcattcaggacctcacggagcgctcggacgttcttagggggtatctttgactacgatgccaagaaagagcgtctggaagaagtaaacgccgagctggaacagtcggacgtctggaacgaacctgaacgcgcacaggcgctgggtaaagagcgttcctccctcgaagccatcgttgaaaccctggatcaaatgcgccagggtctggaagacgtcgctggcctgcttgagctggccgtggaagccgacgacgaagaaacctttaacgaagccgtggctgagctggacgggctggaagagaagctggcgcagcttgaattccgccgtatgttctccggtgaatacgacagcgccgactgctacctggatatccaggccggttccggcggcacagaagcccaggactgggcgagcatgctgacccgtatgtatctgcgctgggccgaagcccgcggcttcaaaaccgaaattatcgaagaatccgaaggtgaagtggcgggtcttaaatccgtgaccatcaagatttccggcgattacgcttacggctggctgcgtaccgaaaccggcgttcaccgcctggtgcgtaagagcccgttcgactccggcggccgtcgccatacgtcgttcagctccgcgttcgtttacccggaagtggatgacgatattgatattgaaatcaacccggcggacctgcgtatcgacgtttaccgtgcctccggtgcgggcggtcagcacgttaaccgtacggaatcggcggtgcgtattacgcacatcccgaccaataccgtcacgcagtgccagaacgaccgctctcagcataagaacaaagaccaggccatgaagcagatgaaagcgaagctttatgaactggaaatgcagaagaaaaacgctgagaaacaggcgatggaagacaacaagtccgacatcggctggggcagccagatccgttcttatgtgctggacgactcccgcatcaaagacctgcgtaccggtgttgaaacccgtaacacgcaggcggtgctggatggcagtctggaccaatttattgaagcaagtttgaaagcagggctatgaggaaccaacatgtctgaacaacaagcacagggcgctgaaaccgtagttgatctgaacaatgaactgaaagctcgccgcgaaaagctggcacaactgcgtgagcagggtgttgcgttcccgaacgatttccgtcgcgatcatacctctgaccagctgcatgccgcctacgacgacaaagataacgaagagctggaatcgctcggtatcgaagtcgccgtggctggccgtatgatgacccgccgcgtaatgggtaaagcctcgttcgtcaccctgcaggacgttggcggtcgcatccagctgtacgtctcccgtgacgatctggctgaaggcgtctataacgagcagttcaaaaagtgggatctcggtgacatcctcggcgcgcgcggcaagctgttcaggacaaaaaccggcgagctgtccattcactgcaccgagctgcgtctgctgaccaaagccctgcgcccgctgccggacaaattccacggcctgcaggaccaggaagcgcgctatcgtcagcgctacctggatctcatcgctaacgaagaatcccgcaacacctttaaaattcgctcgcagatcatggccggtattcgccagttcatggtaagccgcgactttatggaagtggaaaccccgatgatgcaggtcatccctggcggcgcgtctgcgcgtccgtttgtgacccatcacaatgcgctggatctggacatgtacctgcgtatcgcgccggaactgtacctcaagcgtctggtggtcggcggcttcgatcgcgtgtttgaaatcaaccgtaacttccgtaacgaaggcatctccgtacgtcacaatccagagttcaccatgatggaactctatatggcgtatgcggattacaaagatctgatcgagctgaccgagtccctgttccgcaccctggcgcaggatattctgggcagcaccaaagtgccgtacgacgaccaggtctttgacttcggtaaaccgttcgaaaaactgaccatgcgcgaagcgatcaagaaataccgtccggaaacggatctggcagatctggataacttcgacagcgcgaaagccatcgccgaaagcctgggcatcaaagttgagaagagctggggtctgggccgcatcgtgaccgagatcttcgaagagaccgccgaagcgcatctgatccagccgaccttcattactgaatacccggcagaagtgtctccgctggcgcgtcgtaacgatgaaaacccggagatcaccgaccgctttgagttcttcatcggcggacgtgaaatcggtaacggctttagcgagctgaacgatgcgcaggatcaggctaaacgcttccaggatcaggttgacgcgaaagcggcgggcgacgacgaagccatgttcttcgacgaagactacgtcaccgcgctggagcacggtctgccgccgactgcgggtctgggcattggtatcgaccgtatggtgatgctgttcaccaaccgtcataccatccgcgacgtgatcctcttcccggctatgcgtccggttaaataatcacgcgcaacgcgaacaagccctggcagcgatgccggggctttttttatgcggcggcgaaaacgcgcagccgttcccgcacctcgggccgggcgacctgctgcaccatccacgggctgaacgcccagggtgtggcatccacggcgcagaacagcgcttccagtgttacccactgatgatccatcacttcatcggcattcaccgccagcggcgtggtaacgcgcgcggcaaacaccgggcaaatttcattttcgacaatgcctgaaggatcggtttcgcagtagcggaattccggatacaccggcgcaatggcggcgacggtcgcgccgacttcaaactgacagcgacggatcaccgcggcggtaaaatcttccccgctttgcggatgcccgcatacggagttggtccatacgcccggccaggcttttttgtgcagggagcggcgggtaagcaggcactcgccgcgtgcattgaacagccaactggagaaggcgagatgcaggggcgtatcggcatggtgggcggcatatttttcctgcgtcccggccgccatgccctgctcatccagtaaaatcacatgttcctgcaacataatctttatccactctcaatccagccagaataacggctctattatacgtgagggtcaataaaacgttttgctctggcgcgcttaatctggcatgaccagcgacatttattcagtgaactgggtaatagacgctaatgcattttgcatcgcggctgtggctgctatgatatgcagtcatgctcatttgttccggggaagtgttttgattgcaggacgcctgatgaaaaatccgtgtcgacttcttatctgcctggcgttcagcctgttgctggcggcatgctcatcgaaaaacgccgccgacggcgagacttacaccgttaagcgtggcgacaccttatctaaaatttcgcgcatgaccggcaccagcgtcaaagagctggcgcgcctgaacgggatttccccgccttacactattgaaatcggccagcgtctgcgggttaacagcggcggcaaatccggcggctcgggtaagggcggcaaaaccgcgtccgccagaccgtcagcttccgtgcccttagcctcctggccgccggtgggtcaacgctgctggcgctggccgacgaacggtaaaattatcctgccgtactcctccgccgatggcggtaacaaggggctggatattgccggtacgcgcggacagccggtgtacgccgccggtgccggtaaagtggtgtacgtcggcaaccagctgcgcggttacggcaatctgattatgatcaagcacagcgaagactatattacggcctatgcccataatgattcgctgctggtgaataacggccagagcgtgaagatcggtcagaagattgccactatgggcagcaccgacgccgactcggtgcgattgcacttccagctgcgttatcgcgccacggcaatcgatccggcgcgttatctgccgccgcagggcagtccgcctaaatgctaagcgattaatatatcgccggttagccgccatgcggcttgccagacggtgcgtaaggtttataatgccctacgcacctcaaagcgggcgtagttcaatggtagaacgagagcttcccaagctctatacgagggttcgattcccttcgcccgctccagatttattctttcatcaccccaggctgcaccctcaactgattctctccgacctttttcccgtgcctgtcttcgatccagtaattgatctccacgtcctgtttatccgcaggcgttaccgtcacctcctgcactttttgtccggaatcagcaggaatagtcagggtggtttcacccttatccagcacgcgccgatcctgcttcacctgccatttcagctggcactgatcgcaggcagaccaggtatcgttgatcgcccacagccgcacggtggcgggctggccgggctgccaccgggcggtgacaggttcaatggacggcagcagcggctgataggctttttgcagcgcgtaatagcctgctttcggtttgcgcagatagtccaccacgccccagttgatggaaggccaggtctcgacaaacataaaatggaacagcgcggttaccggctggtaacgctgtcggcgatagctttctgccgccgtggcgaccagttccgcctgataggcctgcgtattggcgatcatctgctgcaaattatcgccgcgcgggattttggcgaacttaaaggtctggaaaggctggaagttgtggtatttccagcgcgtccagccaggatcgtcggcggcggtggttttcggccagcgcacttctggcggaataatggtcttcagggtcgacagccgcggcagcgcctgcgcgccgaattcagtaataatggcggttttggccgggccaagcagatcgcggatggtgccgaaataccatccggcccagtaatgctcctccaccgcagaaaagcggtgcacgatgcgcgagttatcggtcgccagcgcatccgccactttgtccgtcagggcgcggtttaaatccttatgccagtcggggaagcgtttttccatccacggcgagttccacggcggttcgttatggccgccccagacgataatggcaggcgagttgccgaactgctccaccatttcccgggtctggcgtaccgcgttgtcggcgaaggcggcactgtcatcgtagccccattgcagcggcacatcctgccagatcatcagccccatctcgtccgccacctcatacagcccgcggcccgccacatgaccgtgaacgcggatggcgttggcgttcatctcctccaccagccggaaatcccggcggtatttttcccgcgtcatggtgctgagccacggcgagccaatatagttagttcccttgataaacaaccgtttaccattgataagccagcctttattctccggctgttcttccactttgcgcaggccggtgcgcgtgacggtggtatccatgagcccctggctatccgtcagcgaggcgcgtacccgatataaatgcggtttgccggatcctttcggccaccagagctttgcggccttcatcggcagatctaccttcagcgtacgggcgctgccgtccgttttctccagggtgacaggaaattcctgctgaaagcgctggccgttaaaattagcaggagccgcgttcaggcgcagtgtggcgctgccgccttcaagggcacggtagcggatcgtcgcctgcaacgcgggattgtccagcccctgacgccagtccgggcgcaggatgatttcatcaatagttgcgcccctgctgagatgcagtctcaccggtgcccagataccccctgagttggcatcctgcccctccggcgaccaggcgccgcctggccgactatcgtgctgattaagcacgcccttcatcaaggctttatgcagcggccagattttcttcggatcttcgaacgggctatccacttttaccgccagcttattatgacgacgcagtgatttagtgacatccaccgcgaagcgctggaaatagccttcatgacgggtcagcgcctgaccattgagcgtcacatccgcaaagtaatcgacgccgtcaaacaccagcgtggccatggtatccgcaggctgcgcgggcagggtgaaggcatggcggtacatcagcgccccctgatgatcgtacccggcgctgtaccagttagccggaacctttagcgcccgccagcccgcggtggaggcggtggtgccatcaaaagcgctgtcattggcgtcatgcacctgccactgtccggcgagggaccaggtcacaggcaccgtggtcgcccgggccagcgggacgagggcgaccagcaacagcatgatcttacgcaccattttttacctcctgcgcccggcgttgcagccacgccataatgcgactggcctcggcatacaggccatcccgcagggttttcagttcgtcgtcatccagcgtctgcgcatcgctctccagccgttgcagcagttgcgtgagatgcccgaaatccagcgccatggcttcgccgcgcagtttatgggcagcgcggcgcaggccgtcacgatcatggttgttcatggcctgcacgatcgtcgccagcgcctcatccagtccctcgcggaacagacctaataactcgtccaccagctccgcatcgtcggcgcactgcttcagcaggcgggcctcatccggcagcccctgttccggggggcggcagacacgcaggatctcatcctgcagcgcgtcctgggtgacgggtttggcaatatagccgtcaaagcccatcgccaggcagcgctctttgtccccctgcatggcgtgagcggtcatggcgatggcaggctgatgcgtctgctgctcttcccgaagcaggcggatggcggtttcgccgtccatctccggcatctgtaaatcaatgagcagcacatcccagcgggccgcgcgccagcgttccagcgcttcacgaccgttattcaccacctcgcactcatgcccgagccgctccagcagccgccgggcaactttctggttaacgagattatcttccgcgagcaatacgtgcagcccctggcgcgcggtttcaggcgcggcctgtggggcgggcggcggcggtgtctcctccgcaggcggcaccggcgcaagcacgctggcgatcacctgatgtagttcgtgctgcgcaaccggcttatgcagatagtgggcaatgccgatgcgtttgagcattttggcgtcgaaatggcggctcattgaactgagcataatgatatggctgtggctggtctgcggcagcaccgacagctccagcgccagggagacgccgtccatatccggcatctgcgcatccagcaggatcagcggccagggcgttcccgccgccgccagtcgcagggcgtcggcggcgttattgacgcaggtgggttgcagtcccatcaggctaagcatggtatcaagcaggcgcaggttggtgctgttatcatccaccaccagtacccgttcgccgttaaagcgcgccagggttgagcggctggcggttgaggcctgctgactggtgagcggaatggtgaaggcaaactcgctgcccgcgccgggttcactggtgaccgacagctcaccgcccatgatcttcaccagcctggcggagatggtcagccccagcccggtgccaccatagcgacgggtggttgagctgtcggcctggctgaaggcttcaaaaatggctttctgcttgtccggcggaatgccgatgccgctgtcgcgcacccggaagcgccagtgacctgcgctgtcggcaggctcgatggccagcagcacttccccctgcggggtaaatttcagcgcgttacccagtaaattggtgaggatctgccgcagccgggtaccgtccgccatcagcacttccggcaccgtaggggcaatatccaccagcagttcgatgcttttttcgctggcggcgggcatatgcgggcggatcagcgactggacgaacgggcgaatttccaccggcgcttcgtccagcaccaccttgcccgcttcgattttagagaagtcgagaatgtcgttgatgatatgcaacagcgactgggccgagctcatcaccagcgaaagatactcccgctgatccgccgtcagcggcgtgtccaggcagagctgggtcatgcctaaaatgccgttcatcggcgtgcggatctcatggctcatattggcgagaaaggcgcttttcgcctcgttcgcctcgcgcgcgactttcgccgcttcaatggcgagcagctcggcttctttacgccgggtaatatcctgaagcgtgccgataacccgctccgcttcacgatcgatggtcatggtcaccacctggccggacagcagcatccagcgccatccctggtcgggatgacgcacgcggatctcgcactcgaagaccggcatatgatcttttttcgaggaggccagcgcctggcgcagggtggcgcgatcctcctcatgcaccagattcagcagaaaacgcaccggatgctgccactgcacccgcgactgcccgaccatcgccagcagggtatcgttgacctgcaggctatcctgcgacacctgccagtcccagatgccgatctggatcgactcggcggtcagtaaaaaatcttcatgcagctggtggcgggaacggcgggcctgatcgagctgggtaatgtcgctgtgcaggctgacgatgccgccatccggcaggcgctgatgctgcacatatagctgccgctgcccggactggcgcacttcataatgatatttctggcggcagttgcggataatggtttcacgcaggctctggcgtttggcggggtcgatgttgtacaccgcatcgataaatttttcggcaagctcttccagcgtggcaccggcggtaagccaggggccgatcaccggataaagctgcgtgaccttatcattccaggcctgcagtcgttcggcagaatcatagatcatcaccgccaccggcagcgcattcagatcgaagcaggacgatgcgttcatcatacctcctgtgcccggtagtgcagctctgcctgacggcgcagatactccagccccggcgcaatcgccatcgcccaggcggtgaggatctcgtcgtcacactcgggatcccgaaggtgaacggtgttcagcatcgcctcgcgccagagggcaaaaaagcgcggcggcagacgcaggccgtcgtgactttgctcgcgggcgaggcgttcgagaaaatccggtacaaacagcacgccgtccacggcgagcatggcgaaaaacgttttgtacatcatctgcggcccttcctcatcgggctggcgggagaagtgcagctccgtctcgggcgtcatgtgtttgaaagcgtcgtaaaaggcctgaaaaaaactctttttatcgttttcagggatcacccggttgaggctcgcctcaaagagatcgcggtaaaacttcatggcgcggccctcgcagcacgttcacccggcaggcacagtccgggcgggttaaattcatccgccagacggcgtgagaagtagctgtcctgctccatcaggccatttttaaacagcggcccggcgttgtgtttatagagcagcgcttccagcaccatggcattggtggagagcgtaagggatttgttgatgtcgccggtggcctcgacgcggccttcaaaccagcccttctgcggatcgttgagatgacgggtcaccgccatcagcgcgtcggtatattcggtgtcccacagcgtccatagggtaaagaccgctttggtcgaaacctgcgacagccgcggatagtcccggccatcgtcccccagggtattccaggcgtagccgttaccccacacggtatcttcgacatgccagggcgcctggccgagtgaaaaatcggcgcgggcggtcagcactttgtctgtttcccagcgtgatttctgggtgagccatacccgctcggcccgcgtgcgcagggtactctggaattcagacggcaggcccggcggttcccagccgaattccagccccggcagcatataggggagggtagtaatgagcgacggctgccaggtggtacggggatcccgggcgtcaacggcgaggctgcgctggtagatgatgacgttgcgcgacggcggggtaaaggccttgtcgaccgggaatccccacaggcggaacgcgctggcggcatattcgctttcgcccagccgcaattcttcgcgcaccaccggctggccgttttgcagcgacgaggaccagagttcgccctctttatccatcaccggacagaaattccagcgcaggataattttatccagatactcgcgatactgcggcgcgcgctcggcggtgaggcgcagcgccagcatcaggcgcgccatatctctggcggaccagccgctttttaccggttttccgctgaagtcgataagggtggcgctctgggtggaataaagtcggcccggcgtacgctgctcgctgagcatcaggcgattaagggtgccaagcagccgcgtcagacgggcatcaaactcatcctccttaatcagatccagctcgcgggcagccagcagggcgatcagcgtgtcgcccatctgccacagggtgacgcgaggttgtttatcgctgccgttgaccagcccggtctgcggctgggtgttattgacgaaatagcgccaggcgatgcccgcccactcctgctcctgcggcgtcagacggtcaatacgcgcgctgctatgccagccgcctttcgtcagccagcgccatcccgccccgtcgcgactaaatagcgcaaaggcgataagcaggacaatcaaaattcccgccagccagcggctcagggttttaaacattgcgccgtcaccggaggaagtttcacgggctcatccgccttacaggaggagcactggcaggcctggcacgcaggtttagtgcgctggctggtgccggtctgttcgcaccaggttttcaccgccggggtactctccaggaacggacgattccgtttggtgttgttctcctcaaactgatcgacaagtttcttctcccacagggagggcgcgaactggcgatctttcgggttatcgctgttaaattgcagcagcttgccctcttttttgaacagcagcgcctccagcatgatgccgttattgttggcggtgaactctttaatcgggccgtcgccgttttcatacagcccttcgtaatagcctttgccctcttcgttggcgttttcaatggtggtgagtaaccgatccgtgtaaggcgaatcccatagcgcccacatgccgagggccgcttttagcgacaccgcagcggtattaggaacatattgtcctttatcggtaatggtgttccagttaaagccatcgctgaatacggtgtcgtagacaaagtacggcgatttatcgagctggtgctccgaacgggcggttaaaatgccggtaatggcgtagcggttctcctgcgcctgatagacacggtcggcgaagtctttcatccacgcgagggaataatcgcgcgggctgttatcgcgatccgtcgggttatcgaaaccaaactccaggccgtaaagcaggtaggattcggttaccacatagttatgttgactggtacgacggggatcgcgtgaatcgtacggcaccagcacgcagtaaatttctgccagctcatagggttccggtcggcttgactggcaggtgctgaatccccataaacggaagcccgccgcgccatattcctcatagcccagacgtccttcctgaacatatttgggctggccgttttccagataagcgccgtataacatgccgcagggatccacggcatggctgaagtcccagcccagcacgatattatccacgctgttgccatattccggataacgctctttgatgaccctcaaccagatcagcatcctgccaatgtccagcgctgaaaagccgatctcgccgggtttgttctggtagttcaccttctgcccgctgatggtgttgtaggccttgttagggagttcatcacggaacagcaccagtttattcagcgtggcaagcaatttgatcatgcgccgatcgaattccgccttatcaataatccccagctcgcgggctgcggtcatcgccgccatataagacgcgctgtcccacatggtggtggacgggtatttgtttaccgcgttcaccagcccggtggtgggctgatagttggagacgaaatattgccaggcgtttttcgcgatggccatttcccgcgcgctcagctcgccgctgcggggatcgtagccggaagcaggcaattcagtagccgcccgtgcgcccgagatcgccagccagaacgccaccaatccggccaaaagtgggaaaaagaacaagcatttcagcttcatggcgtagctcctgctgaagaagtggatcgggatgcgtcgttaaaacaggccaggcacagcatctggccgtgggcaatgtacgccaggctttcaaggaccaccgcattggtatcggcgtcaatcaccttattcacgctgttattcagattcaggccgcgctgccagcctttgccgggtacctgtaacggctgcacctgctggcgtaacgcctcgctccagctgttgcggaacagggcataccaggcaaaggcggagcgggtggaggtgatggcagtctgctccggggtggcatcgagcagggcgctgttttgcaacggctggcgatccggcagatcgttgacgtagtccggcgcaggctcggcataatcggtactgatgggcggtttacgcacccgcaggctgttgcggcgctgctgaatttgcataatgcgccaggtgatttccgcgctttgcgcgtcaaagcccagttcgaggccggttaacagatagggcaggctaatgagcgacggctgtttgccccagggggtgcgcaacccttcgtccggcaccatcacgccatcgatgtcgatcatctgctgtccttccggcggattcgttaccgccagcccggcggcgctgtcgatcagccgcagcgtgtggctggcatacagccggtagccgtagctgttgcgcggctcgtctgtgttcagcgcccagtgatgcagcggcgcggcggcctgggtggcggtgctggtgaccaccatcgccccggtgttccactggttaaagagatcgcgaatggcgggagcgtgctggggatagcgccacagcagcgtttgcagggcgttcagcaatcgtcccatgccgatggcggaggtatccggttttcccagcattttcagcgtgtcggcgtggtaataagcggcgggcacgccctgcggattcagcggcaactgaccgagggtaaagagggcggcagtaacgcgctcgtcaaactcggcggcagtcagaatgttaagctgttttgccgcgctcagggcaaacaggtagctgccggtactccacaggctgaaccagggttcgcgatcgtgggcgttcgccaggccattaggctgggtgttgttgacgtaatactgccaggccacccgcgcccagatcgcctcatcaaaggtcagctcgcgggaggcgggcagcggcggaaaatccttgctgaggctcagcccgccgctgctttcaacgcgcgagggcatctggtgctccacccataccacaatggcaaacccgagcagaaaacccagcaggatggtgagatagctgcgggcggaaagcagggcgtcacgcgttctcattggctggcttcctcttcagcaggtgtccatatggcggcgaggatcaggggcaacatggcggcgatattcaccgcgccccagaaaatattgatcacgtagccggaagggtcatccacctggccgcgcgccacctgtatcccgccccagatcagccccgccagggttaacaccacgatggcgatctgcggtttcaccagatagagaaaacggccggtctgccgctctttcggcgttacgtggaatttgatctgctcgccgcgcagcacggtatccagcgcccgtaagttcatggaaaagaaggagaggtaagaggcgcggccatcccaggcggaaatcccccaggtgccgaacataaaggccagctccgagaaaatgaaaaaaggtaaaaagtgcaggtaaaagggcgttgaccaggcggaaaccggcggaatgccggtgaacagataaataatcggcgagatcagaaataccgtattccacacgcaggccatgtaagaccagaaggtggtggcatacatcagcgtttgcggcagcgacagcttaaagcggcgacggctgaagatgttgtcatggaagagaatatccagcgatccggcggcgtatttaaagcgctggatcatccacgtcagcatatcctgcggcgagagcattttggattcgatgcgcggatgcatcacggagcgccagttgcgcgccgcatcgccgtgcagcaggatggaggtgtaaatatcttccgagacgtgaaatttatagggcgtcagctctgtatcaaaggcgacgtgcgggcgcatggcatcctgcaaggcttcgcgcgtggcaggatcgcggatgtcgcgggtgtggcgggaaatctcttcttccaccgtccatacatagctgcgtaacgccgcctgcatcaccgcttcgcgacggtgaatggatgccgcaccgcaacagaacgccgcgttggcccagttacgccgccgcaggatcacgtcataaaacatgcggggatcgttgaaaaagggatcgcggccaatggtgatcgggccgacgattttttgcgccagccagccgaggccgtagccaggcttgcccgctttacgccccagccagcgcgccaggctttccccttccggcaggtcgtaaaaccactgcggcgtctgcacccaggcgacatccggatcgcggaaatagcccagcgtatggctgagcagtgtcgggaagacccgcgtgtccgcatcgcagataacaataaaatcgccgtcggtttgctcaaggccgttacgcagattaccggccttataaccgatattggtctgacgggtgatgtaattgacgccttcctcatcgcaaacggctttcatctccggccgccgtccgtcgtccagcacatgcacctgataatcgagcggaaaggggtactgcattttcatcgcatcgcggatggacagcctgaccagctcgacgtcctcagaataggtggcgatgaacagatccactttcactggccgctgctccaccgcgtcttcagccagcagacagtcgttgatctccgcgggcggcgggttctgcggcggatcctcttctttccagatattgatggtaaataatactgtgccgatccaggcgaaggtttccgccagcaccagcggcacggcgtaccacagcgcatcggtattcagagaggcagtccagcgccagtaaatataattgccgcccagaataagcgccgctaccgctaatacctgccaggtcatcatcacccagcgcggtgttttaagcggttcaggcggcctgcgattttcaaaacgggaaaagtaaaaatccatagcggtggatatcctgcttccgtgatgatgaattattgatgcattacaggcaccggcctgcccggaaaagtaaagtcaaaacaaaacgaaaagtaaattaagtgtagaagcccgtaaaaaagtgtccagcagaataaattgccataatttagccgggcttaacttactatcattgtcactaaataaaaaatgagtgccgatgaataattgccagaaccatttatttaagctaaataaataatttgaaacatttttttgggatgagtgtaagggaaacctatgagccagattgcgccagcgctaccaaaaaaagaaactgaaaaatcagtgtcatggcgctatgcgatcccgggcaaccgcgatctgcgtattgacctgatgcgtggcattgcgctggtaatgatggtggtggcgcataccgagttactctctgtttttaatattttcacctgggaacgattcggcttaactaccggtgctgaaggattcgttattctttcaggatttatgcttggcatgttaaatcgcgcgcgtctccagaaagtagtattgcttactgtatcgtggggactttatctccgggcatggaaaatatatcgtgtaaatatcattattatagtttccttcttattgctggggtatttgccgtttatcaatgtttttgaagtaacccattttaccgatcgcttttccggtaccacctggtccctttatccggtcacaccgcaaatcaaagaaacctggtttaatatcattctctatttgcagataggcccgcatcagacgcaaattctcggcctgtatatttttttgttactgttaagcccactatttctggggatgctgagtaaagggaaagtgtactggctgttaagcctttcactgctggtgtacggctgctggcagcgctggccgctgcgcgttacgccgtccgaatttgagttcgcctttccgctgctggcctggcaatttatctttgtgctgggcatgtgtagcggctggtacaaagaagagttgctctcttttgcccgcacgccctccggcaaagtggtggtggttgccatggtggtgatcgcccttatcctcgcttttgtcgcccagaaccataccaacccctttatgccgcacgccctgctgatgcatgtgatttcccctgccgatttcaacgccttttatcatacctgggcggcgaaaaacggcctcgggccggtgcgggtgctgaacgatatttgtctgatggtgacggtctatctgctgctcagctggtgctggctgccgatctatcgtgtggcggggtggtttctgatcccgctgggacaacgctcgctttataccttcattttgcatgtctatgtggtgctgctggtgagccagtttgtgaccttcgatttatggcggcaggcatggatcgaaaacaccctcattcacgcggccgcgctgggcgtgttatggctgatggcgaaatacaacgtcgccgctcgctggatccctaactaaggaaaggcagtatgcgtgagaaattcttgctggcctgcgcgctgctatcggccgccaccgcaacggccgcagcggaagcagacaaaaaagagactttacgggatgaagccggcgaaccggtgcaggtgggggttttcaccagccgctggggacggcttttctccggtaatgaggataaattttccggggcgctgagcttcacttcagggctgaaggagcagaggatcgccattcctaacagttcatccacggcggagcagaaaaagaaatataaccagacgctgaacctcagcctgcaatattcaccctacagcttctggttcgctaacgtcacttcccgtctgccggtgacggataccagccgttacacggcggatttccgctacagttttggctatgacgactggcacgccaataccgttagcctggtctacagcaactatggcgacaatcacttctggacctccggcagccgccgtaacacctattttgagcagggcgccgtgacgctggcctataaattctcgctgccaaagcccgtggaaaacgcgctgttgatcaataaaggcgactccattatctgtcaggcgggctacagctgggtgccgcgctattacgatttaagcagcaacgatatccgcaaaaacaaaaacgtcatgctgggcggctgcggttataccttcaaacagcatttcttcgtgcgcgccacggcgttctggtatcccgacagcagtcagcagcagccgtggaacggcgattacagctacagttttggctatgcgggctatacgccgggatctttttccgtgcagtacgccaactattccggcacgcgttatccgggtcatcagaccggcaatgggaaatttcgtgaaggcacggtcagccttacctggttcttaccgctataggggataccatgtcgccacaacaggttctggttgttgaagattcaccggtttaccgtcgtctgctggtgcggatgctggcccagtggggctatgcggtgagcgaggcggaaaacggcatcgccgcgctgcatattctggaaacccagccggtgagcatggtgatcagcgactgggaaatgccggagatggatggcctgacgctgtgccgggagatccgtagccgccagtttggtcactatatttatgtcatcctgctcaccgcgcgggaaaataccggcgatgtgacccttggctttgatgcgggcgcggatgattttctcagtaagcccgtcgagcaggcagagctgcgggcgcggctgcatgccggggcgcgtattctgacgctggaggcgacgctggcggcgcacaacacgcggcttagcgaagcgctgcggcagattgaactggatctggaagcggcggcgcgtattcagcactcggtactgccgtcccaccagttgcgctatcaggattttttttccgactggctgtttttgccctcggcctgggtatcgggggacattttcaacgtctttccgctggataaccatctggcgttttactgcgtcgatgtttcgggccatggcgtcggcgcggccatgatgtcccttgccgttgcgcgccagtttctgcatggccgggcagtggagcgcttcttatttgccgataatggcgaggtggcatcccccgccgatgtggtgcagatcctcaatagccgtttttgcagcgaagaggcagagatcatgagctatttcacgatgatttatggcgtcatcgatctcgacagcggccagggacggctgtgccaggccgggcacccgacgccctttatcatcactccgaacggcgacgcgcgcgccgtgggcaacggcggcgcgcctgtaggcttaatgcccgatctcagctgggaggacgtgcacttctcgctggctgcgggcgagcggctgtgcctgttcagcgatggtattaccgaatgcgaggatccgaccggcacgcagttcggcccgcaatctttacaacactggctgcaaagccacacaactttgccgctggacgaactgctggcgcagtttggtcaacatttgatccgctggcgcaacggtgaaggcgatggcgataacgcgatggccgatgatgtttcactgctgctgatcgagcgaaaaggagaagcgtaatgcacattgatactgaacgacatctgaacatgaatatcctcaccccttcaatccgccgcctcgacgcctccgttgccgcggccttcaaagaggcgatcatgcgggaagtgggggaagatcgtaaggcgctgatcatggatttcagcaaaattgattttatcgacagtagcggcctcggcaccctggtgtcgctgatgaaaatgatgaacggcaggggagaaatggcgctgtgcagcatgaacgccgggatccgcaatatgtttaccctcacgcgtatggatcgtattttccgcatctgcgccgatcgcgcagcggccgtcgagcagctgaaccatggcggataaacagcgttttgcggcgtcgctccgctcgcttacgccgctggccgggtggctggcaaaccatatggcggatctgccggtgcaggaggagtggcagttcgcccttgatttagccgcctgcgaggcggccaccaatatcattcgttatgccctgcacgaggacgacagccgatcctttagcgccgaatttaccgccacggacgaagaggtctgcctgcgctttaccgacagcggcgacgccatgcctgacgggctgattgaggcggcgcgcgcgacagactttgcggagatgtcgccgctgatggaaagcggccggggactgaagctgatcctgctgtgcgtcgatactttcgattacgcgcgcgaggcagaccgcaatatcaccacgctgataaaaaaggtggaaggttaaatcggctcccgctccagccagaaaatcaggcgggaaaatatctcgttctgcatggccaccttgttgtacatcatgtaggtacgcaccccgttcagctcaaaatctgtcgccagttctcgtaggggatacagatgccgactctgttcatacagccaggccggaataatgcccagcgtatcggtatgggctaccaccgcgggaatactctgcactgaaaaactgctgtagcgcacctgacgttcgccgaactgactttccacggtggccagcgttgactgcaatcccagccgtttggtgttgagcacggcgaatttctccagccgggcttcggcggcgctgatctggctgccgaggcggggatgatcgcgtcggcagatcacactgagcttttcgtcgaggatcgccgtggtgacgatggctgaatgaaagacaggctccacatcaaacaccagatcgacatcgcgctgcaaaagcagcacgtccggcgtgtcctgggcgcgtatcacatcccggtgcacgatccggcagccgggggcgttgagttcggcccattgcacaatgcgtggaataacgcgcgtcgcaaaccaggcgctacagtggataaccagtaaatctttggtggtggcgttcgccagcgcctccagcgaacttagcaggccgctgtactgtttcgcgatctgcaaatgaatagtttccgccatagtagtgggtgtcagactctgcccattacgcacaaacagcggatcggagaaatagacgcgtaatttctgcaaagacttactgataaaggccggggaacaattaagcgcctccgccgcgcgcgttacgctgctgtgtttataaatctcattgaatattcccagcagtttgaaatcaaaattaacgccgattaccgattttttgcacatctactgttccttcagaggtaggctggtggtcagctttcatcaatgaaagctatcatttaagtaacatctcctggcgtgaaacattccggttttcacgagccataaaagatagatttttaaacaatgtaagaaagttgttgcggttttaacatttttaatttgttgtttattaagggttaaataagaaattgctcttttttattccatatgcaggcatacttaacccggcggtaaaaatcttattaccctgacgaatctttcggcctggtcatttctgtaacataattccctgaacactcagtttatattatctggaacaatttcgttaatacctaacctgtatcttgtttaaatatttcctgtggttatttgtctgcgcttttttaaatcatttattcagatatttatcaagttaatgaattgacaacgcgtgcccgtttaaaggtcgattatgaataaataccgtttatatcaacacgccattattatgatggcaggcttattcccgttattcccctgcgtcgttcatgccaccggtatggttcctgaaacaacagcgctgttaattgatgaagaaaaaggcggcgcgagcatgaacgtaaaaaataccgacaataaagcggcgctgctttataccaccgttcaggagccagacggcacgccagcgcaggacgcgactctcgtcgttacccagccgattgtgcggctggaagccgggcagactcagcgggtgcgctttgtgctgaataccaccgcgcctttaaaagtggagcagtacaagcgggtaatttttgaggggatcccgcaggcaaaagcgccgggtaaaaaacagatcaccaccaccattcgccagaatctgccggtaattattcacccaaaaggcctgccggtattaaccacgccctgggaaaagctggagtggtcggccgcaggaagcaccctgacagtcactaatcccggcgcttatgtggtacgtctctcgccgcaagtggtgatgcagccgtctggcgtgacgggcagcctcggaaaaacctggatcctgccgggtgaaacgctctccatctcgctgaaatcacccaccaccgataaacaggtgaagcttttccccgcttcccgctatggctttgacgtcggcagctatatcgccattgtgaaatagcccgtgcagatgagaaaggatccactgttgctgatgagcactgtgctggcctgcggggtgttcagcgcaatggcagcgtgcgccgcgtctgaaggcgtttcaccgacgaacggcagcgaagccgcgctggagttcgatctgcagatcctgcgtcagcgcggtgtcgacccggcggtagcgggctatttctcccgccgtgcccgctttgcgccaggcaggaagacggtagatgtgtcccttaacggcaggcgcgtcggcagtattgccgtgctgtttaacgataacggcgatccctgcgtggatcgggcgctgctggaggctctccgcctgaaagcgcctgcatcggacaagggcgaccgctgttatgactatgccagtgcctttcccggcaccctgtttaccctgttgccgacggaagatcgcattgagatggtcacgccgccggaggcgctgttgccgctgtccgggacagcggaaaattatgccaccggcggcacggcggcgctgcttaactattccctgtttaccagcagcagccagacggacggcgggcgatacgactaccgccagggcacgtttgaaagcgggctgaatttccacgactggctggtgcgcagcaagcagatggtcagccagtccgacggaaaaatgaacagtgaccggctctacacctacgcccagcatacctttaccggcatcaagaaaatcgcccagctggggcagatcaacgtcggcagcacgctattttccggcagcgccattaacggcgttcagttggtaccggcaacgacgctggacaacgacacggggagcggggtgacggtgagcgggctggcgcagatgccgcaggcgcgcgtggatattaagcagtccggcgcgctgattttttcgacgctggttccggcagggcccttcaccctgaaggacgttccggtgatcagcgccaataccgatctgcacgtctcggtgacggaaaccagcggcgcggtgaatacttttattgtctccgccgccagcttttccagccgactgcctggcagaccgcaagggctgtcgatggcgctcgggacgctgcgggacgtggagacgccgttcgataaaccctggctggcgaccttttcaaacggctggcagatcaccgatcgcttcaatctgtctgcggggctgacgaccgccaacaaatatcaggcgctggcggcaggggggatctgacgccggtaaaggatctgctgctgaatgcccgcctgcttcgcgcccgcgatcggctcaatagcaatcaggggcaacagctgacggcctcggtcagctacatgacgccgtttcgcctgaacctgagcctgtccggcacgcagaacagccggggctaccgggatttgcaggatactttcagcgagggggaagcgctccataccaggcatgactacgccctgtcactgggctggtcgcatcaactgacgggcagcttttcgctggggtattcccgttcgtctggatttgacgccagcagcgacgccacgcgcctgaccgcttcctggagcaaaaccttcagccgggcctcggtaaatcttagctggcagcatgaaatcgaccgggactccgggcgttatgccagcgcggcttaccagagcggcggcgacaccttatacctcaatgtcagcattccgtttggcgcacagagcctcaacctctccgcccatgacgacggcagcagtacccgctttggtgcgcagacggcgggcaaaataacgccacaggtcggctacaacctgtcggcggaaactacagacaaccacggcgaacgccgcataaacggcggcctgaccgccaatctgcgctacgtccaacttggccttaacgccgggacgagcgggcataacagccgcaacagctcggcgacgctcgatggcggcatggtagcccacgcgggcgggctgaccttctcgccttacgccgtgcaggaaaccttcggcatcgccaccctcgatatacccatgtcaggcgtggaaatcagcacgccgcagggcacggtatggaccgatcgctggggcaacgccgtggtgccgtccctcgctgcttatcaacgctcaaacgtcatggtgaacactgaatcgctgccgaaaaacgtcgacatcagtaacggtatgaggacggtgagcgccgggcacggctcggtaagccagttgcagtttggcgtgctggcggtgcgccgcgtgatgctgacgctgatcatgccggacggcagaccggtaaacaaaggcacggcgattttcaatgccgccgggcagtacgtcaccactgcggtagaggacggcgtggtctttatcgtcgatgtggaaaacagcggtgagctctacgcgccggtcgatgacgcgggccaccagtgtcgtctgatctttgcgcccggcgatgagccggatctggacgcattttacgaacacgcccgcgcaacctgcgtggcgggagaagctttatgagatcgaaactgaccgtgcctgccgtcgcgctgctcctgctgagcagcacggcgcggggcgacatcaacaactgcgtaatgcagctctcgccgctggagcatgactacggcgatctgacccgcgatcgtcagacgtttattaccacgccgcagggaaaggttgcacagcttagtgaacgccgtagcaacctgagcgtcacttgcccggaaaaagcgctaatgcggctgcgcttcaccggcgacagccatgctgacggcagctttcgctttggcagcaagggcaggctgaacgtgactatcggagaggcggtactggatggcaacccgatgttgttaaccagaaccacgccccagggcgacgccgtggccgccagccacagcctgcgcgcggcggatgaaatcatccccggcaatagcagcgtacagggtcacaacctcaacctcaccctgactatcacgccataccttgccggggcggcgtttgtggtcccggacactcagctacaggaggaacttatccacatcgaactactgaacacgcagtaatggaaaagggcagtcgcccgccagtgtattcataacaagcaagagatggagcaataaaccatggaaatgaagtccgttctgaaaaccaccgcgttaggcgtcctgatgatgaccgcgatgaccgcgcaggccttgccggtcaataccaatctgatcgtcaaaggcaccattacgcctgccgcctgcgtgccgacgctggctaacaacggtgttatcgactttggggacacctccgccggaagactgccagaaaatggcagcctggcgctggaagcaaaaagcctgaccgccacagtaacctgcgccagcgccgccagcgtggcgatgacctttaaagataaccgtgcggataccgtttcgctggtcggcggtgaaagcacgaaagcggaacaggcgtttgggctgggtaacgccggggggatcaatattggttcgtacggtataaaaatcacccatatcacgggcgacagcgccgatggcgtggtgctgcacagtagcgataaagagagctggtccaaattggcgtcgacggaattcgtcaataacaacgccgtcccgcaatatctgacttttgggctcagcggcaacaatgtgccgaaagaagcgaaagtgctcaccttcgatctgcaggtcatcccggcgctgaattcagctttaaaagacatttctgaagcagtaaaccttgatggcaatgccaccctcagctttgagtacctgtgaggcgcgcggaattccggcaactcaccagataaaaggaatcgattaatatggaaaataactcaatgaaaaccctactgaaagccactgctctggcaggcatgatgctgacagcctccgcaggcgcagccattgatgataatacgctgcaagtgacgggaactgtgacgccagcatcctgcctcccggcactgtcgaacgggggtgaagtcaattttggcaatacgatttcggaaaagctgacgcaaaaggataaccagctgccgcctaagaccctcacttttaccatcacctgcgaccatgcggcgaaagtatccctgcatatggttgacaataacaccgtgggtcaccggctgatggtcattaaaaatgcttaccataatgatgacgacaataatgaggccgcctaccagttcggcatcggcaaaaacagcaaaggcgatgccgtgggcgcgtacagcgtgacaatcgccggcagtcctgtggtgaatggtgacgccaccaacgttattgtctccgctggcggcgtctgggggtatagccagactcatgcgtttaccaacgggactggtgttaacgctttactgagcgtggcaaaacctgatggtgaaattatcccgatggcctttaaggttctggaaatgacgctgagaattaatgcggccgtggcctctaacacggatgtggagatgaccgacgccattgagtttgacggcagctccactatcgtaatgacttacctgtaattctccggaatatcgccctgcggcaggctgattaatacctgccgctttctttttcccgccccgtagtcaccacgcgttcatatcggtatgctaaattcgacccaataaaaacaacacaccgagccaatgtcatggataaagcactcctggatgcgggctaccgcctctacagcggtcagcaaatagatgtctatttcaataccgcactctgtcagcatgccggaaagtgcgtacgcggcagcgcggcgcttttcgatctgaaacgcaaaccctggatcatgccggatgaagtggatgcggcaacggtcacacgcattatcgacacctgcccgagcggtgcacttcagtaccgccagaaaaaagagagtgaataatggaaatccttgaaggccataataaattttatgtgaataatgccgacggcgagcagatcgcggaaatcgttttcgtcccgaccggcgagcatttaagcattatcgaacataccgatgtcgacccgagcctgaaaggtcagggcgtcggcaaacagctggtggcgcgcgtggttgaaaaaatgcgtcaggaagagcgaaaaattatcccgctctgcccgtttgccaaacatgagtttgataatacccgcgagtatgacgatatccgcgcctgatagtacgcatgtgagtatgcaatgcgaagtcatcggcgtctgaatatataaagcccgcataatgcgggctcttaaatttcagttacaggttaagcgcaattcgcttaccgtctggcagggtaacatctaacgttaactctccgcccagcgccgtaacatagcgcttgagtgtagaaagtttcgggtcattatcgatcttctccatcttaacgacagaaggctggcttacgcccagcgcggcggcgagttgtgtctgcgagacgtttagctcttcgcgcagtttcgctaaggtaatttcctgacgtatttcagcggcacgcgcctttatgcgatcacggctttctggagagcgtttagccatcatttctttaagcgtcgccattttctttaacctccggtgatttcagatgcgatttgaactcagcatcggcaatcttaatcatacgtttatagaagattttatccgtttcacctttcttatctgccgcgcataacacaatcgcttttcgctgcggatcaaatgcgaagaatgcccggaatggatgccccgcaacctgtacgcgaagttccttcatgttctggtattgcgatcccttgatctggtctacctgtggtcgtcctaagtgtggaccatcctcttcgagaatgacgaagtgggctaaaatttcttcctgtacttcctcggtctgttcctcaaaccacctatcaaacagctttcgcgtaatgatttcccacaccaattcccttatctcctataacctgcgggttataaaattttataacccacaggttataatggcaagtgatttcccataaaatagcctcctttaaagatttataatgattctcatgaatgcattcccgatatttagtaaaaagccataacattattatctgatgtccttttcttttattgattattcctctgacccgctgcactgcgctggtacaaatatggtcgactttagtgcagcgtcatcttaaatatattcccgatatatataaataaatcaaattaatcattgagttaactttctggcacggcagttgctatctggatttcatcttgtataccaacagggatccagaacatgacagcaatgacaggaaatacgttgtcggcatggcaacagcatatccaccagcatagcgatgacatattttcactccttgaggcgtatgccggatccctggcgtcggaagataacgcctggatcgccattgccagcgctgcgcagatccgcgagcagctcgacgccttattgccgcagtaccagcagaacccgcaggcgctgccgttattcggtattcccttcgcggtgaaagacaatattgacgtcgcgggctggccgaccaccgccgcctgtccggccttcgcttatgctgctgagcgcgatgccttcgcggtggcaaaactcaaagcggcaggggcgatcgtcatcggcaaaaccaatctcgaccagttcgccaccgggctggtgggcacgcgctcaccctatggcgcggtgagcaatacttttaacgcggattacgtcagcggcggctccagctccggctcggcctccgttgttgcgcgcggtctggtgccgttcgcgctgggcaccgacaccgccggatccgggcgcgtcccggcggcctttaacaatatcgtcgggctgaagcccaccaaaggctggctctccgcgcagggcgtggtgcctgcctgtcggctgaacgacacgctgtcggtcttcgccctgacggtggaggacgccttttatatcaccacccttgccgcaggccacgacgccggggatgcctactcccgcgtgcatccggccagcgcgcctgccgccatttcacaaaatccggtgtttgccatcccggcaaccctcaccttttttgacgatgcgcaggcggaagccgcgtgggaacaggcgttggccgcgctgcgcgcaagtggcgcgaccctcaagccgattgatttttcagccttcacccgcctcgcagaacagctgtatcaggggccatgggtggcggagcgtaccgccgctgttggtgaaatgctggatcacccggcgcaaatggatcccaccgtgcacgggattatttccgggggcctgaaattcagcgccgtggaagcgtttcaggcggaatacctgcgcgcggaactggcgcagcagattaacgccgccctgcgtgaggtggatgcgctggtggtgccgacctcgccgaccattcacaccatcgatgagatgaagcaggagccggtgcgctttaactcgcagtttggcacctacaccaactttaccaatctggcggatctttccgcgctggcgctgcctgcgccgttccgcgccgacggattacctgcagggatcacgctgatcgccccggcctggcacgatcgcgcgctggcggatttcggcgtgcgctggcaacagcaactggcgctgccgctgggggcgacggggcgggatttcacgccgtcctgcacgccgctaccggtgtcggcgcagcatgtgcgcgtggcggtagtcggtgcgcatctgcgcggtatgccgctcaatttccagctgactacccgccgggcggtctttgtggaaaccacgcaaaccgccgcctgctacctcttgtatgcgctggcgaatacccagccgcagaaaccgggtcttgcccgcgcggatgagggggcggccattgaggtggaactgtgggacatcccgctggcccgcttcggggaattcgttgcggagatcccgccgccgctcggcatcggcacgctggagctgagcgatggccgtctggtgaaaggctttatctgtgaaccggcagcgctacctgatgccacggacattaccgcattcggaggctggcgcaactggatcgcccgccaggagacccgccatgtttaataccgtccttatcgctaaccgcggcgaaattgcctgccgcgccatccgcaccctgaagcgcctcggcatcaccagcgtggcggtgtactccgacgccgacaaaaacgccgaacacgttaaacaggcggatgtcgcactgccacttggcggagaaaaagccagcgacagctatctgcgcatcgacaaaatcattgccgcggcgcaggagagcggggcgcaggccatctggcccggctacggttttctctccgaaagcctggcgttcgccgccgcctgcgacagcgccgggatcgtctttatcggcccgaccgcagaacagatcggcgagttcggcctcaagcaccgcgcccgtgagctggccgccgccgcaggcgtgccgatgacgccgggcaccggtctgctcaattccctgccggaggcgcttaacgccgcggagttgatcggctatccggtgatgctgaaaagcaccgcgggcggcggcggcatcggcctgacgcgctgcgccgacgacgaggcgctggcacaggcctgggaaagcgtgcgccgtctgggagagcagttcttcagcgatgcgggggtattcctcgaacgctgcatcgatcgcgcgcgccatatcgaagtacagatttttggcgacgggcagggcaacgtggtggccctcggcgagcgcgactgctccctgcaacgccgcaatcagaaagtggtggaggagacgcccgcgccgcatctgccgcccgccacccgcgaggcgctgctgaacgccgccgtgcaactcgggaaacaggtgaactaccgcagcgccgggacggtggagtttatctacgacagcgcacaggacgccttctattttctcgaagtgaacacccgcttacaggtggagcatccggtgaccgagtgcgtcaccgggcttgacctggtggagtgcatgctgcgggtcgccgccggggagtccatcgactgggcgcggctggcgcaggcaccgcagggcgcggccatcgaagtgcgtatttacgccgaaaacccgctgaaaaacttccagccaagccccggcgtgctgaccgaagtggtgttcccgtcggacgtgcgcattgataccggcgtcatcaccggcagcgaggtgtcagcgttttacgatccgatgatcgccaaactgatcgtccatgcgccaacccgcgaggcggcgctggcaaaacttcagcaggcgctgaacgccacgcgtctgcacggcatcgccaccaacctcgattatctgcggcagatcaccgccagcgacgccttcgtggacggcaacgtctggacgcggatgctcgacagcgtaacggtggagagcgcggtaattgaagtgctgcaacccggcacctggagcagcgtgcaggattatccgggacgcctcggctactgggacatcggcgtgccgccgtccggcccgatggatgattttgctttccggctggcgaaccgcattgtcggcaaccacgacgcggcggcggggctggagtttaccctgcaaggcccggtgctgcgttttcacgccgcggcggtgatcgccctgaccggcgcggactgccaggctaccctggacggcgagaccgttcccctgtggcagccggtaacggtgcaggcggggcagacgctggcgctgggccgcgcgcaaagcggttgtcgcggttatctggcagtacgtaacggtatcgacgtgccggaatatctcggcagccgatccactttcgcgctcgggcagtttggcggtcacgccgggcgcaccctcagcgtggcagatctgctgcccatttcccgtccggcgctgatcgcctgcaccacgcccgtgccggtgagcgagccgcaggggctgtcaccggtgctgatcccgacgtatggcgatgagtggcgcatcggcgtgctttacggcccgcacggcgcgccggatttcttcacccaggcgtccattgacgacttctttgccagcgaatggcaggtgcactacaactccaaccgcctcggcgtacggctggtcgggcctaaacccggctgggcgcggcccaacggcggcgaggccggactgcatccctctaacgtgcatgactgtgaatacgccattggcgcaattaactttaccggcgattttccggtgatcctcacccgtgacgggccaagcctcggcggttttgtctgcccggtgaccatcgccaaagccgaactgtggaaagtgggccaggtgaagcccggcgaccgcatccgcttttatccgatgagcattgaggaagcggtggcgcgggagaacgccatggatcgcattatcgactcgctgcaaaccagcccgctggctacctttgaggtgccgtccctggcggagcgcaacggcgtctccgcggcggcgctggtgtcgcttccggcgtccgccggtgcgccggccattgtctatcgccaggtgggggataactacattctcatcgagtacggcgataacgtgctcgatctggcgctgcgtctgcgcgtgcacctgatcatggcgcaactgcgtgagctgtcgcatcccggcattaaagagctgtcgccgggcgtgcgctccttacaggtgcgttacgacagcaagcttatcagccagcaggcgctggtggcgctgttgctggaaaccgaatcgcgcaccggcgatgtcagccagatgaaagtgccgtcgcgcatcgtgcacctgccgatggcctttgaagatcgcgccactcttgacgccgtcagccgctatcaggatacggtgcgcgccagcgccccctggctgccgaacaacgttgattttattcagcgcattaatggtcttgaaagtcgcgaggcggtgaaggcgacgatttttgacgccagctatctgatcctcggcctgggcgatgtgtacctcggcgcgccctgcgcggtgccggtcgatccccgtcaccggctgttaagttccaaatacaacccggcgcgtacttttaccgccgaaggcacggtgggtattggcggcatgtatatgtgcatctacgggatggattcccccggcggttatcagctggtagggcgcacgctgccgatctggaacaagttcctgaaaaacgaccagttcagcgcgggcgaaccctggctgctgcgcttcttcgaccaggtgcgtttctacccggtcagcgaagaagagctggatcggctgcgggaggatttccgcgaaggccgcgccaccgtgcgcatcgaagaaacggtgttcgatttcccggcacacctgcaattcctggacgataacgccgacgacatcagccgtttccgtcagcatcaggccgccgcttttgagacggaagtggagcgctggcagctggacgatgacagcagccaggagatcgcgccggtggcagaagaagcgatcgacgaggacgcgcagccggtgatggccgacatgagcggcaatatctggaaagtgctggtgcagccgggcgacgaggtgacagccggacagccgctggtcatcgtcgaggcgatgaaaatggagctggcgattgtcgcgccgcaggcggggcgcgtgaagcgtcttggctgtaagcctggccgtccggtcaatcccggcgacagcctgctgtggctggagtagcacgatgcaaatggcggcgagcggtaaaaatgacaaaacgcgcagcgcggggctggcggaacgcatctatcaggcgctgaaaaacgaaattttcgatttccgcctgatgcccggcgagcatttcagcgaaagcgagatctccgcccgtatgtccgccagccgcacgccggtgcgtcaggcgctgttctggctggagcacgaaggctatgtgcaggtgtattcccgcagcggctggcaggtgcggccttttgatttcacctactacgaagcgctgtatgactttcgcatcgtgctggagcgggaagcggtgcgccgcctgtgcggcatgccgccgggtctctgttcagagcatcttgcgccgcttaccgccttctggatcgccgcgccgcgtatgacgccgggcaaggcgctgtcgctgatggacgaacagtttcataccacgctggtgcagagcaccggcaacagcgaaatggtgcgggtgcacgtcgagctgacggagaagatgcgcattattcgccacctcgatttcacccgcgaggatcgcgttgaggcgacctacaacgagcacgcccgcattttgcaggccatcgaagatcagaacaccggggaggcgcaacagctgctgaccggacacatttcccaaagcaaagccgaggtcagaaaaatcacactacacatgctccagcaggccagtttgcaacccgtttcaccgtagtcaacaacaacactcactcaataccatttaggggtttagtcatgaaaagacgttcgttgctgaaagcatttgccctgtccgccacctttttgagcatgggcttttctctacaggcatacgcagcagagaccattaaagtggggatcatgcactccctctccgggacgatggcgatctctgaaacgccgctgaaagacatggcgctgatgaccatcgccgagatcaacgccaaaggcggcgtgctgggtaaacagctggagccggtggtggtcgatccggcctccaactggccgctgttcgcggaaaaagcccgtcagttactgagccaggataaagcggcggtggtgtttggctgctggacctcggtatcgcgtaaatccgtgctgccggtatttgaggaactgaacgggctgctgttctacccggtgcagtatgagggcgaagagatgtcgccgaacgtcttctacaccggtgccgcgccaaaccagcaggcgatcccggcggtggagtacatgatgagcgaagacggcggcagcgcgaaacgcttcttcctgctcggcaccgattacgtctatccgcgcaccaccaacaagatcctgcgcgccttcctgcacagcaaaggcgtgaaggatcaggacattgaagaggtctatacgccgttcggttacagcgattaccagaccattgtctccaacatcaaaaaattctcggccggtggcaaaacggcggtgatctccaccatcaacggcgactccaacgtgccgttctataaagagctggcgaaccagggcatcaaggcgacggacgtgccggtggtggccttctcggtgggtgaagaagagctgcgcgggatcgatgccaaaccgctggtcgggcatctggcggcgtggaactactttgagtcggtcagcaatccggtgaacagcaaatttgtcgccgattaccgggcgtatgccaaagcgcacaagctgccgaacgccgataccgtggtgaccaacgatccgatggaagccacgtatgtcggcattcatatgtgggcgcaggcagtggaaaaagcaggcaccaccgacgtggataaagtgcgcgcggccatggccaaccagtcattcgccgcgccgagcggcttcaccctgaccatggacgccaccaaccatcacctgcacaaaccggtgatgattggcgaaatcgaagataacggtcagttcaacgtggtgtggcagacggagcaggcggttcgcgcccagccgtggagcccgttcattgccggtaacgacaaaaagccggatcacccggtgaaaaccggcggtaagtaattcccgcagggcagaggcgtggggcggcagacgcggccccacgctgtggctgaactcacccggaaagacagtgacatgatgaaaatactcccggctttgggcgttcttcttttaagcggtctgctgatggcaagccacgcatacgccgggcctgccgctgagtacggtcaggccagccgcgcgcagcagatccagttgctccagcagtgggccgccgcgcctgaagcttcacgcctgccgtttctgcaaaagcttaatgaggcggaagtggtgacggatacgcgcggtcagctgtttacgccagcgggtgacaaatttatcccgctggaaggcgaggccgccccggtgggcagcgtcaaaaaaatcttccttaataaccgcctgcgcgggctgatcaaaagcgcgctggcctcgcatcaactggtcagccccgatgacgccgtgcggcttcaggcggcgctgacgttacaggctaatgctcaggccgatcagctgccgctgctcagcgcgcgcctggccgcggaacaggatgatcgggtacataccgcgctggcgattgcggtggcgaatttacagctggcggacagccgggcggaaaaacgcctggaagcggtgaaactgctgggtgaagccagcgatccgcaggtgcaggccagcctgatgcgcctgacggatccgcaggcggagccggatccggcggtgcgtgccgccgcggcggaaagtctggcgcaggtgcagcagcgcctgaagtggggcgagtggctggggcaggcgttcagcggcatttcgctgggatcgatcctgctgctggcagctttggggctggcgatcacctatggcctgctgggggtgatcaatatggcccacggcgagatgctgatgatcggcgcgtactccacctggctggtgcaggatctgttttcgcgcgtggccccggagtggctggcgttctacccgctggcggcgctgccggtggccttcctgatcaccgccgcggtgggcatgatccttgagcgtaccattatccgccatctttatggccgaccgctggaaaccctgctcgccacctgggggatcagcctgatgctgatccagtgcgtgcgcatgctgtttggtacgcaaaatctcgaagtggccaacccggcctggctctccggcggctgggcggtactgccgaatctggtgctgccgtacaaccggctggcggtgatcctctttgtggcgggcgtgctgacccttacctggctgctgcttaacaaaacccgtctcggcatgaacgtgcgggcggtgacgcaaaaccgccgtatggcggactgctgcggcgtgccgaccggacgggtggacatgctggcgttcggtctcggctccggcatcgccggactggggggcgtggccttatcgcagctgggcaacgttggcccggaactggggcagggctacatcatcgactccttcctcgtggtggtcaccggcggcgtcggccagctggcgggcacggtggtggcggcgctggggctgggcgtgctcaacaaagtgctggagccgcagaccggcgcggtgctggcgaaaatcgccattctggtcctgatcgtgctgtttatccagaaacggccgcaggggttatttgcattcaaagggcgggtaattgactgatgagccaaccgataacgctgaccctggcccgacgcgcgccacgtctgaccggcttttttaccgggctgttgttactggcgctgctggcgctgccgtttctggctttgctgcccgccgcacacccgctggcgatctccacttatacgctgacgctgatcggcaagatcctctgctatgcggtggtcgcggtagcgctggatctggtgtggggctacgccgggatgctgtcgctcgggcacgggctgtttttcgccctcggcggctacgccatgggcatgtacctgatgcgccaggccgccggcgacgggctgcctgcttttatgtcgtttctgtcgtggacggagctgccctggttctgggcggggacacaatattttgcctgggcgctgtgcctggtgatcctcgtgccggggctgctggcgctggtgtttggctggttcgccttccgctcgcgcattaaagatgtctacttttcaattatgacccaggcgctgacctatgccggaatgctgctgtttttccgcaacgaaaccggctttggcggcaataatggttttaccggcttcacgaccatgctgggctttccggtctccgccaccggcacgcgcatcgggctgtttatcgccaccgtgctgttactggcgggcacgctgctggtgggcgtgctgttaacccgcagcaagtttggccgcgtgctgacggcggtgcgcgatgcggagaatcgcctgatgttctgcggctacgatccgcgcggctttaagctgttcgtctggacgctgtcggcggtgctgtgcgggctggcgggggcgctgtatgtaccgcaggtgggcattattaatcccggcgaaatgtcgccgaccaactccatcgaagcggcgatctgggtggcgctgggcgggcgcggatcgctgatcggcccgatcctcggcgcggggatcgtcaacggcgcgcgcagctggtttaccgtggccttcccggacttctggctctttttcctcggcctgatgtttattctggtcacgctgtttttgccgcgtggcgtcatcggccttattcaacggaggaagcatgactgatgcgctctttacccagccgctgccgcaggatcgctttcgggaaaccaccgatccggtgttgcagctggaaaaaattaacgtcacctttgacggctttcgggcactgacggatctgtcgctgtccattggcgtcggcgagctgcgctgtgtgatcggccccaacggggcagggaaaaccacgctgatggatgtgatcaccggcaagacgcgaccgcagagcggacaggtgttttacgatcagaccatcagcctgctggaactgtcgccggtggagatcgcccgggcaggcattggccgtaagttccagaaaccgacggtatttgaagcgctgagcgtgctggaaaatctggagatcgcgcagaaaaccgataaatcagtgtggcatagcctgcgggcgaagctgaacggcgagcagcgcgatcgtattgatgaagtgctggaactgctgcgtctgaccgggcagaaacagcgcccggcgggactgctctcacacgggcaaaaacagtttctggagatcggcatgctgctggtgcaggaaccgcatttactgctgctcgatgaacccgccgccggccttacggatgcggaaaccgaatatatcgcgggggtgttccgcaagcttgcgggcaagcattcgctgatggtggtggagcacgatatgggctttgtggaaaccatagccgatcacgtgaccgtgctgcatcaggggcaggtgctggcagaaggctcgctcgcgcaggtgcaggcgaatgagcaggttatcgacgtttatctggggcgctgatcatgttgcaggttaaagagttacagcagtattacggcggcagtcatattctgcgcggcttatcctttgacaccccgcccggcgagatcacctgtttgctggggcgcaacggcgtgggtaaaaccacgctgctgaaatgcctgatggggctgatcccggcgaaatccggcactatccactggcagggcaagctgattaacaatgcgaagccgcaccagcgcgttcagcagggtatcgcctatgtgccgcagggacgggaaatttttccgcgtctgacggtggaggaaaacctgctgatggggctgtcgcgcttttccggccgcgacgcgaaaagcgtgccggaggagatttatgcgctgttcccggtgctgcgggagatgaagcagcggcggggcggtgatctttccggcggtcagcaacagcagctggcgatcggccgggcgctggcgtgccgtccacagctgttgatcctggatgagccgaccgaggggatccagccgtcggtaatcaaggagatcggcgcggtgatccgtggcctggcgaaccggggcgatatggcgatattactggtggagcagttttacgatttcgccgctgagctggcggataattatctggtgatgtcgcgcggggcgattattcaggcagggaaggggcatgagatggaagcgcagggggtacggcatctggtggcgatttagtgttgtggggtggtgcccggcggcgcgttgcttgccgggcctacggtcaatacctgtaggccgggtaagcgccagcgccacccggcacaacagttacatcacaatgtcgcattcccggcatgcatccccggcaccaggatcaccttgcggcactcctcctggcgtttctcgaagatctcatagccacgcgccgcatcttccagcggcatatggtgggtgacgatctcttccggcgtcagatggcctttttcaatcagcgccagcagatccggcaggtacgcatggacatgggtctggcccattttaaaggtcagccctttgtcgaacgcatcgccgaacataaaggcgtgaataaagcccgcatagacgcctggcacgctgagcacgccaccgcgacgtaccgccgcgataccctgacgcagcactttaccgctgctgccttccagcttcaggttgctcagtaccgtttcggtcaggctgcctttggcttcaaagcctacggcgtcgatcactgcatccacgccacgatgacctgcggtgtgctcaatgatgtacgccgccggatcgtcattgtcgtcgaagttgatcggcacaatgccatagcgctgtttggcaaactccagccggtagtcgttatggtcgatcataaagatcagctccgcgcccatcagacgggcacaggcggcactcagtaaaccgaccggacccgcgccgaagatcgccacgctggagccttgcttaatatccgcgtttttcaccgcctgccaggcggtgggcagaatatctgacaggaacagcactttctcatccggcagggtatccggtactttgaacgggccgacgttggctttcggtacgcgcacgtactcagcctgaccgccgggaacgccgccgtaaagtttgctgtaaccaaagagcgcggcgggcggcgtaatggatttacggtttaaggtggcgccgccgccgctgttggtgttttcacacgcggaatactggtgcatatgacagaaaaagcagtcaccgcaggcgatcacaaaggggatcactacgcgatcgcctttcgcgacggcgtgtacatctttccccgtctcgaccacttcccccataaattcatgaccgaaaatatcgccatgatcggtgccggggatcttcccgcgatagaggtgaagatccgaaccgcagatcgcggtggcggtaacgcgcaggataatgtcgtccgccgcttcgatactcggatcgggcatggtatcgacactgactttatgcgggccgtgataggtgagtgctttcattattgtttgctccggtatcgtaatcgcgtgttaaacagaaactacgtcagatcttgccgttacagcgtgccggtaccgccatcggagcaccagacctgacctgagctgtagctgttttcattggaggccagcgtcacataaatagtggcgatttcggcaggctgcccggggcgacccagcggcgctgaggcaccgaactgctccagtttttcctgaggttgaccaccgcaggcctgcaacaccgtccagtatggccctggcgcgaccgcgttcacgcggatgccttcttccgccagttgttgcgccagggatttggtaaaggcggcaatggacgctttagtctgggcatagtccagcagcgtcgggcttggctggtaggcctgtacggacgaggtgttgatgatagacgcgccgcgtggcagataatccagcgccgctttggtgatccagaacatcgcgtagacgttagttttaaaggtggcgtcaaagtcttcggtagacagttcgcggatatggttgcggaactgctgacgaccggcgttattcaccaggagatccagcccgcctaactcttccgccgcctgtttgaccagctgctggcagaaggattcgtcgcgaatatcgcccgggatcgccacggctttacggcctgcggcgcgaataagttcaattacctcgcgggcatcttcttcttccgccggcaggtagttgatggcgacgtctgcgccttcacgggcataggcaatggccaccgcgcggccaataccggaatcgccgccggtgatcagcgcttttctgccttccagacgaccactgcccttataggaggtttcgccgtgatcgggacgcggattcattttacaggccaggccagggaagggttgatgctgacgttcaaacgggggaaccggatagttgtctgccggattggagatacctgcggtggtgacgccgtttttattgctcatgtttcgctccttctgtgtggctttgggtctattaagcatagatcatcagcgtgaaatgccagttttctcggaattttgcacataaaaagttgcttaaaaggcatttgccgcttcgtttagccagcctggaaaaatctgcaattcgcaatgctggcttgcgccatgccgcaaggtgcaaaatacttgaagcattgaaaatcgtttggtttttggttgcagatgtggcaaagcccaccgacaaccgctgaaacgagtgaggatgtggtgacagacacttacaaaaatgcttctggcaacagcacgtctttacctgcgcttgcgcccccgtccggggaagagacgctgggaagggtggtgatggaattgctgcgaggcggacaggaaatcaaccggcatagcctgtgcgtcaaactggccgcgcagattgacctttcaaccgatccggcgctggaagcgcagctgagtgaacttcttggtctggtgctaaataaaagttaaaattcattgtgaatatctatgtccaggccctttctttccgccgctgacgcagccatactcaccgggttacaccgtgcctaacggtaacaataatgagaggctcaatgagcaaaaatgataaggaaagactggtagataccatcatgggggaagcggtgttgcatcttctcgaaaatgatgacaacgtttcctttgatgcgcttatcggccagttacaggaaaatctgcaaaatgaaaccgaccgggaaaggcgcgatgctttccggaccgccattaacggtgttcatcagttccggtcgctgcaaactcaatcggtgagcacgccgggatcgctaaagcagagtttgcgcagttcgctggcgcagaaaagtacttctaccactaaacactaataccactaaacactaatctgtccctctgcttaaccttcgggttagcagagttcgcccttctaatcagacttgctctggcatgcttcatcgatgctcctgtgactttgataatggctccggccatagaagaagacatcccaccccgcattgagagtgcaattgaaagaagatgaacagatttttcttgaaaatattcaagaggctatcggcgaggctgcgactcatcttatgagtaacggtcatgctatagacgccgaaaatatcatcctcgtactgcgcgcacgccgtatgatgacgaccgatccacaccaccagcacgtttttgaaggagcctgtaagttacttaaggttcgggtaaaacaatccgcgtaatctcagaattcacaccggtcagccgtgcgtgtttcacggtagaccgggtggatttttatcaaaacttacaggtcatctggcgtttgctgaacaatcttttccagcgcgctgcgatagacatccagttttacaacatcctcttccgtctcaagtaagcggatcaccgccagaataaggttcttattggtgacctctatctggttacgcttcagacttgccgaaagctcctggatgaacagtctttcggcttcaaacgtctgcgcgctctggccgaagtattcattcaactgttcttctgatgtcgcggtgtgcataaaagatcctcaaaattcataacgttttcctctcaatatggcgagagggtatgagtaaccgaataaaattagtcatcattaagattatccgcaatatggcacgtgcaatttcttcaaaaattttttacgcaaacgttaactattttaagaatgtgcttatcaaatgttaagctcagttctgcaccagcttaatcttctgccagtgcctgtttcagatcttccagcagatctttctcatcttcgatcccaaccgataaccggattaactgcggcgtaatgccattagcgagacgttgcgccagcgggatagaggcgtgggtcataaagaacggctggctcaccaggctttccacgccgccgaggctttctgccagcgtaaagagcgtgagacggctgatgatttgcgcggcacgctgttcatcgcctttcaccacgatggagatcataccgcccggcagcgccatctggcggcgggccagctgatactgcggatgtgattccagccacgggaaaaagacctgttcaacctgcggctgctgttccagccattgcgccagccgcagggcgttgctgctgtgccgctcaatacgcagcgccagagtgcggatgccgcgcagggtgagaaaactgctgaagggatcgagcacgccgccgacggcgttttgcagatagccaagttgttcagccagttcagggcgatcgcccaccaccgccagcccggccaccacgtccgaatgaccgttaaggtatttggtggcggagtgcaccacgatgtcaaaacccagcgccagcggacgatggatcagcggcgaggcaaaggtgttatccgccacgctgatcaggttgtggcgtctggcgatggcggcgatggcttccagatccgccagcttcagcagcgggttggtcggcgtctcgacccagatcatccgtgtgtccgggcggatcgccgcctccagacccgccagatcatccggcttcacccagctcacctgtaagcccgtgctgcggcggcgcacgttttcgattaaacggtaggtgccgccgtaaacatcgtcgatggcgacaatgtggctgtctttgtccagcagctccagcaccgtggaaatggccgccagcccagaggcgaaggcgtagccgcgcgcaccgccttccagttcggcgatggcactctccagcgcgtgacgcgtcgggttgccgctacgggagtattcgtagccggtgtgctgacccggtgcaggctgcgcaaaggtggaggtggcgtaaatcggcggcatcaccgcgccatgctgatcgttaaacgcgccgctgtgcacgctgagggtatttaatgttttcatttttcttccttacaggcattgctgatcagaccctgctcgcgcagccagtcgtcgttaaacatttttgagagatatttgttgccgctgtcgcaggcgaaggtcaccacgcgtttcggcgtggtctgggctgcgcagtaacgcagcgccgccgccagcagcgtaccggtggaggatccggcgagcacgccttcgcgctgtagcagcaggcgcgcggtggcaaaggcgtcggcatcgctgacgcggtacgcctgtttcacgccctcaataagcgcaagcggcggaataaagtcttcgccgatgccttccacccgccatgatcccgcctcgccgtgccgcccgctttccacctggtcggcaagaatggaaccttcgggatccgccagcacaaattcggtatgcggtgagtggcgcgcaaaccaggcttgcaggccgccgagggtgccgccagagccgacgccgacaacaatggcgtccacgcgcccgtcgagctgatcatatatctctttggcggtggcagcgtgggccagcggattggccggattgttaaactggtcgatgtaataggcgccaggcatatcctgcgccagacgcagagcgtaatcctggtaatacgccggatggcctttggtgacgtccgagcgggtgagcaccacctctgcgcccagcgcccgcaggtggaagatcttctcgcggctcattttatccggcaccaccagcagtacccggtagcctttttgcgcggcgatcagcgccagccccagcccggtattaccggcggtggcttcaataatggtgccgcctggcttcagtaagccttcccgctcggcggcttcaatcatcgacagcgccacgcgatctttaatcgacccgccgggattttggttttccagcttcaggtacagctcacagggcccgcgctgcagcttatgcagctggagtagcggcgtatggccgattaattcagtgacagaatgggcaacagacatggtgtgcgatccgtagttaacacgatgcctggataataggtctgcgattttcgcggattaaagaatctttctctgcattttagatcgaaaaggaatatcacctgctgttcagccatcaggaaggaaatccctgtagacatccggacgtgttgattgctataaaacggcacttttgccgtaaaaacaggcgaatggcgcataaattgtccgtgatttatgcgttttttagctaaccaatgctgaaaatatccattacacagccaacccttttgccatactggttatagctaacaggtataagcaatgatgattaagttatttcaattataattgcgacagattattatcgtctggacatccatactgctaaaccgccaaaacggatagaacacatacatgatcgtccttcggaatatttccaagatttttgaccacggaaaggtgcctatcaccgccgtggatagcgttaacctgacggtggagcagggacaaatttacggcattatcggctacagcggcgcaggaaaaagcacgctgatccgtctgcttaacggtctggaaaaaccgacctccggggatgtcaccatcaacgggcagaatatttccagcgccgagggcgaagcgttgcgccaggcgcgtctgaagatcagcatggtctttcagcactttaacctgctgtggtcgcgcaccgtcagcgagaacatcgccttttcgatgcagatcgccggtgtgccgaaagcgaaaatcgccgcccgcgtggcggagctgattgagctggtgggcctgaccggacgcgaaaaagcctacccgtcgcagctcagcggcggccagaaacagcgcgtcggtattgcccgcgcgctggccaacagcccggacgtgctgctgtgtgacgaagccacctcggcgctcgatccgcagaccaccgatcaaattctcgatctgctgctggatattaaccgccgctttaagctgaccattgtgctgatcacccatgagatgcacgtggtgcgcaagatctgcgatcgcgtggcggtaatggaaaacggcaaagtggtggaagagggcgatgtgcttcaggtgtttacccatccgcaacagccgatcacccgtcagtttgtgcgccaggtgagccagtatgcggaggaagaggcctttaacccggcgctggcttccggtcttgatggcagcattatcaaactgacctttaccggcaataaaacctatcaaccggtggtcagtgaactgacgctgcgctacggcctgtcgtttaatattctgcacggcaaaatgacgcaaaccgcacatggcctgtttggtcagctgtgggtacatgtggtggcaaatcaggaacaactgaacaatatccttgccgatctgcaacagagtgatattgaaggcgaggtaattaagcatgattgagaatttactgccccacctgaaatgggaccagctgtgggcggcgacgctcgaaaccttatatatgacggcgctgtccggcgtggcgacctttgcgctcggcctgctactggggctggcgctgttcctgaccgccaaaggcggcctgttccagaataagccgctgtacagcgtgatttcggtggtggtgaacgtgttccgttccatcccgttcatcattttgattgtgttactgatccccttcaccaagacgattgtcggcaccattctcggcgcggatgcggcactgccggcgctgattgtcggcgcggcgcctttttatgcccgcctggtggaaattgcactgcgtgaagtggataaaggggtgattgaagcgacgcgttcaatgggcgcgcgcctcagcaccctcgtattccgggtattaatccctgaatcctcgcctgcgctggtgtccggtattaccgtcacgctgatcgcgctggtgagctatagcgccatggcaggtgttatcggtgccggtggcttaggaaatcttgcatatctggaaggattccagcgtaaccataacgacgtcacgctggtggcgacagtaaccattctggtgattgtcttcatcattcagttctgcggcgacgtgttgacctctctgttagataaacgctaaacataacaattactggaaaccaacatcatgaaaaagacactgacactgattgccgcagccaccctgagcgccctgagctttgcttcctgggccgataccctgaccgtgggcgcatccaacgtgccgcacgcggaaattctggagcaggcgaagccgatcctcgccaaagagggtatcgatctggaaatccgtccgttccaggactacatcctgccgaacaccgcgctggcaagccgcgacatcgacgccaactatttccagcacatcccgtatctgaacagcgtgctgaaagatcatgcggatgacaaaacctatgatttcgtcaatgcgggcgcgatccacattgagccaattggtatctactccaaaaaatacaaatcgctgaaagatctgccggaaggcggcaaagtcatcatgcgtgacgcggtggcggaagagggtcgtattctctctatcttcgagaaagagggtgtgatcaaactgaagccgggcatcgacaaagtgaccgcccgcatcagcgacatcgtggaaaacccgaaaaagctgaagttcctgccgaacgtcgaaggttctctgctgccgcagatgtataacaacgacgaaggcgacgcagtggtaattaacgccaactatgccatcgatgctggcctggatccggtgaaagatccgattgccgtggaaagcggcgaaaacaacccgtacgccaatatcatcactgtgcatcgcggcgatgagaagaaaaaagagatcgtcgagctggtgaaagtgctgcactcgaaagaaattcaggagtggatccgcaccaaatacaaaggcgcggtgatcccggttaacaactaaccctgccccttcacgcgtcagctgccgctggcgcgtgtttccctcatcctgccgtatgaaattcctctgtgatagtagtcaccaatcctaaacaattaagaaaatagttaataacaatcctctactattgccgggacaagctaagcagaggtagagatgaaagatgtcgtgatcgtaggggccgtgcgcacgcctatcggctgttttcagggcgctttatctcgtcattctgcggtggaactcggcagtctggtggtcaaagcgcttatcgaacgcagtggcgtgatcccgcaacatatagatgaagtgatcctcggacaggtattaaccgccggtgccgggcaaaaccctgcccgccagacggcgatcaagggcgggctaccgaattcggtgtcggccatcaccattaatgatgtctgcggatccgggctgaaagcgctgcatctggcgacacaggcgatccagtgcggcgaggcggatatcgtcatcgcgggcggccaggagaacatgagccgtgcgccacacgtgctgacggacagccgcaccggtgcgccgcttggcaacagccagctgatcgacagcctggtgcatgacggcctgtgggacgcctttaatgattatcatatgggcgtgacggcggagaatctggcgcgggagtacggcatcagccgtgagcgccaggatgattacgccttacgctcccagcaaaaagcccgcgccgcgatagacgcggggcgctttcgcgacgaaatcgtgccggtgctggtggatcgccccggcgggcagacgctgcgggtggagtgcgacgagcagccgcgcaccgacgccagcgccgaagggctggcggggctcagcccggtctttgatcgcagcggatcggtgacggcgggcaatgcgtcatccattaacgacggcgcggcggcggtgctgatgatgagcgaaagcaaggcgctggaacttaacctgccgatcatggcgcgcatccgggcttttgccagcgtcggagtggatccggcgctgatgggcattgcgccggtatatgccacacggcgctgccttgagcgcgcgggatggcagctacaggatgtcgatctgatcgaggccaacgaagcctttgcggcgcaggcgctgtcggtcgggcagatcctggaatgggacgagcggcgggtaaacgttaacggcggggccattgcgctggggcatccgattggcgcgtccggctgccgtattctggtgtcgttggtgcatgaaatggtgaaacggcgggcgcacaagggcctggcgacgctgtgcattggcggcgggcagggcgtggcgctggcgatcgagcgcgactgattttgtcttgtgtgccgggcggcgctgcgcttgcccggcctgggtttatggctgttttgccgggcggcgctacgcttgcccggcctacgtttgtggtgttgggtctctgtgtaggcccggcaagcttgcgccgccgggcgtgccagactcctcctctcaactccccctcccgataaacatcaataagctaatccttactgttttaaattttttgaaattgaaatttctgtctgcaaattaaccctgatgccatgggtaatgaataattataaatttaatgatgactaaaaaataaagtcacaacaggtactatatgtctgctaatccactatcatgctgataaatatggtttttcattttttatgaaatctttgttgttactaagttaataatatatttatgtgatcgcagtctttatttaatgccattatcacaaattattattgatgctcatcacgtcttcccgctctgcttttcagcaagcaaataattacgatccggatcactaaaaaatcctttttaaaaaaataaaatgcagtctcataaaaacggaacgatattttaaatttttgagggttttttcatggttaaaaagtctctggtccttgcgtctctcattggtgcatcatttgcggcccaggccgtaaccgttgacctgcgtcacgaatatattgacagtggcagcaacgccgaccgtgtttctgtatcccaccgttttgataatggcatcggttttggtgtggaagcaaaatggaaatcaggcggtgaagatgcagataaaccattaaccgaaattgtaggtaatggccatgaagaatccattaactggcgctggaaggcgacagataattttgcgctgacgccaggttttaatattgaaagtaaagacaccttctccatttataagccgtatctgcatgcgcaatatacctttgacagcggcttttatgtagcgggtcgttaccgctatgagtacacccgtaaccctgactcagatgtggttgataacaaagtaaataaattcgacgcctgggtgggctgggcgatgggcgactggcgtaccgagctgaactacgtctatgccaaaagcaccgaagacgtggttcgtgaaaatggtaaaaactactccaacgaatataacgccaagctggcttacaaatgggataaaaactggtcgccgtatgttgagctgggtaacgttggcgtgagaaataccgatgagcgtcagacccgttatcgtgtaggcgtcgcatactccttctgatataaaacttaccctcatgagatgccccggcgcagttagtcggggttttctcgtttttgttatttatggcactggcagataatctaataaaataataatcagcggatctaaaggctattataaataaaaaaaggccctccagaaggagggcaaggccagttacagaaacactaactcaattacgcttgcaacatttcacgctgctcaggaagcttcgcaatataaagggctggtttgccgtctttatcggagctaaacaggatcgcactatcgtccggcgtaaaggacgggtgcgggtgagtcacctgacgactattttcgaaggtggcccatgaggtatcgtgacgcgccacgcggaaatacgcgcgctgcgccacatcaaagacataaagataaggatcgttatcgatggtgtagccgccggtgtcttttacatcaaccggcgtgccggaaccatcgccgaccagcagcgtgccgtcgaagttgctcatcagatgtgaacaggcaggcatctgcatgacgtcttcattcacaccggtgtccggattaaaacgggagatcgtgcggccctgttgtcctttcagataagagacgtacaccagcgcagaaccgtccggcacccagaactcatgggtgcagctttcgccttcggcgtgatctttcactttgcgcacattgctgccgtcttcattaaccagccacatgcgggcgtcgatcagatcgtgcgggccttcgtgacagaacgccacggtgttgtcatcgaatggacggtaaatcgggtggccgagccagattttctcatcgtggatcactgagctttcgccgctctgcaaatcaattcgcatcaggcggcaatggggacctttatggaagaagtcgtgaaacagctgccagtcggtaagcggcgtccagtcgcttttcgcgatctcaatgcccaccagtttggtgcagtcgctgttggcaacccaggtgccgtaacctacccagtcatcggacacgcggtagacttcgcgctcttcaaaggtggtaaggttgacttcgcgcagagtgcgatcgttcttcacgtaataaagggaacgatcgtctggggaaaggaaaccgccgaacgtattgtcgccgctgccttccgtcagctgtacggcttcggccttttcaatattcagcaagtagtagttccagtgcccgtcaaattcaccggcgaaaagcagatgactgccatcgttgaaaaaacacttctgatagaagtagttacgatggcaggtgacttctggtggggttaagcgggtgatctccgcacccgtatcggggtcacggctgacctcatactgaagttttacccgcatgcctttcgccataatgcgctccttttcctggtccggttgtagggcggtgtcccaaagagttgatgagtttaaaagctgggtgttaatttatcaaaacgacgtttcaatgtgtgtgacaggtggcgcactttatgaggatctccttaatttattttacataacgacgtctggccccggtgcagaagctctgggatcttcgtttttcaacaataaaactcactcaaaatgggtaaatttaaaggtattttaagtgtttgttttaagtgatttttattcgagagaaaaacgccagagataatcccgtcgtgttgtcaactgcgtacaatcgtgatcctctttacacttttactatttaattacagaaaaagtgaaacgttgttttatttagaattgaaaacgcgttttaagcgggatactatgtgcccatactgcaagcggaacactgttttaatgcttcgctgcatgacatctcagtcagtttctttggaggttaatgtggaagtcagacaaagcatccacagcgcgcatgcaaaaacactggatacccaggggctgcgcgatgagtttttagttgagaaagtgttcgtcgcggatgaatacaccatggtgtacagccatattgaccgcatcattgtcggcggcattatgccagcgaccaaaaccgtgtctgtgggcggcgaagtgggcaaacagctcggcgtgagctacttccttgagcgccgtgaactgggcgtgatcaacatcggcggcgcgggcagcattactgttgacggtcaggtttatgaaatcggccatcgcgatgcgttgtacgtcggtaaaggcgctaaagaagtggtgtttgccagccgcgatgcggcgaacccggcgaagttttactacaactgcgccccggcccataccacctatccgaccaaaaaagtgacgccatctgaagtatcgccggtgacgctgggcgatccgctgaccagtaaccgtcgcaccatcaataaatattttgtccctgatgtgctggaaacttgccagctcagcatgggcctgaccgagcttgagccgggcaacctgtggaacaccatgccgtgtcatacccatgagcgccgcatggaagtctacttctacttcaacatggacgaagacgcctgcgtgttccacatgatggggcagccgcaggaaacgcgtcacattgtgatgcacaacgagcaagcggtgatctctccgagctggtctattcactcaggcgtgggaacgcgcgcttatacctttatctggggtatggtcggcgaaaaccaggtctttgatgatatggaccacgtcgccgttaaggatctgcgctagtcgcggacagcataagttaactctgcctgttcgtgcaggcgctgcaagattaaggaacaaacatgattctggatgcattttctcttcaaggtaaagtggccgttgtctccggttgtgacactggtctgggtcagggtatggcgctgggcctggcggaagcgggctgcgacatcgtgggcatcaacattgttgagccgacagaaaccatcgaacgcgtaaccgcgctgggccgccgttttctgagcctgaccgccgatctgcgtcagattgacggtattccggaactgctggagcgtgcggtctccgaattcggccatatcgatattctggtgaacaacgcgggtcttattcgccgtgaagatgcgattaacttcagcgaaaaagactgggacgacgtcatgaacctgaacatcaagagcgtattctttatgtctcaggccgcggcgaaacactttatcgcgcagggtaaaggcggcaagatcatcaacatcgcttccatgctttctttccagggcggcatccgcgtaccgtcttacaccgcatcgaaaagcgcggtgatgggcgtgacccgtctgctggcgaacgagtgggcgcagcacaacatcaacgttaacgcgattgcgccgggctatatggcgaccaacaacacccagcaactgcgtgccgacgaagagcgtagcgccgcaattcttgagcgtatcccggcgggtcgttgggggctgccgagcgatctgatggggccggtggtgttcctggcctccagcgcgtctgattatattaatggatataccgtggccgttgacggcggctggctggcccgttaattaatcatattcttaaatgattacgccctgcccgaagcagggcttttttatgcctgaaataaagtaacttccaataaaatattaaaaaactttatattttatttctgcattatgatttttgtgagacatctcatttaatatataattgatatgaattacgctaatgattaatgaaaaaatgagatattgatttgctgattgctttgtttaacttgttgatttttagtggttaatatttcttttctgaagggtatttaacctaattttttataatgttgttaaagtgcaacatttttatctctcatccgaccatcgtgtcattatcctatttcatgctgcagatatcatgtcactgtggcattcgaaaaataaatattcttataatgacgcgcctctattgcatgaggggcagtcaattcaacaaggattttttcaaacataaggaccaggaaatgagaacgttaattgattcatggaagaaaaaagcgaatcggtatcaggagctcaaaaaacagaagggtgtgaccttactggaaatcatcattgtactgggtattatcggtattattgcggcgggtgtggtagtactggcacagcgtgcgtttacgtctcaggatatttcaaacgttattgatgataccaactcagttcgtgtcgctatgaccgaagcgtataaagacagcatggaatatccagcgcttgtatctgtaattgatatcaccaaagctgatattgccaaatcaagcagtaaggctgccatcgtatctctggttaaaatgggcaagatcagtcccgacgaagcatttaatggtttctccaatgatgcgttcgaaattggtcacgctaaactggggacaagcgatgcaaaatttaagggtttctatttagtcctgaatggcctggaaactgaagattgccgcaatgttatctcacaagttggtgctcagtgggactatgtcgccacgactactggtcgtgcaggggaaaatagtggtcaaaatgatgaattagatatgagcgttcctgttacaactgctggcgtattgaaatctactactggggaccgtctgaaccctgaagaaattgttgcgaaaggtatctgtgatgctgatgccggtgcgggtaacgcgatcgtactcggcagtcgttaattaaccaagcattaataatactaatatttcatgccctctgatcctcagggggcatctttgtcagaatggatgcatgacatgacgaacaggcagaataataaaccgggtcgtgcggatgcaggcgtcacattattagaaatgataattgtgcttgccgttattggcgtggccttgatgatgctcgccaattataaacgaaaagaagcacagcaaacgcatcagcaagttatcgctgagatgatcgtgcgcgatatttctggcgtgcttaagttcaccgcgcaaaccaagctggatattcttgatagcggcaataatcctgcgacgaaagacaatcccctgtacgatgataaaaacccggataaggctaattataataatcgggtagaaaataagaccctacaggatcagcctgatactgaagaaaaaaatttttattctgcctggtccagggatccagaaaaagtcagccaggtgtcaacggttaatggttcccgttacctcttcctcggcagtgaatgccgcggtcccagtggcgcaaaaggcgcattaaaattcaagcttgcagacaccatgctcccatgtgaaatgcgtgcaggtgcagaagatttcgaactggtgctggagcgcgtggattttgttaacaacagcggtagcactggcgctctcggtattcagcgcatcgatttttacctgacgcatcaggcagaagccgaggatgagggactgcattttaccggctttattaaaccgctggaaaaagcgctgcgtaatgcgggcctgggctatattcaggcggcagtcgtagagatcacttcttccggcgattttaagctgattatgaagaattcgaaggtgattgaggtcagtgatgttgccagtaatatggatctctttgataccgataaacgctacggtatccgcctgagcttcgataaaagcagcgagtatattccggctgacggctcggtgcctgtcgccaaaatgtgctggaatgatgtaaaaggtgaagccgggccctgcatttccgccattgattccgatcgcctggtgatcaaaaccagtgatgcagcgggcaaaaacagcgatgaaccggcgatgtgctgggataaagaacagaaacagagcaccctgtgcctggcagcgatgaatagtaccggcgttaatccaaacggtgagaatccggacgatcgcatcctgcatttacgcaccacttcaagtaaaaatgatactgaagtagtgccgggaacgccgagttcactcaagggtactaccggtacgctgtatgccaatatcgtgatggaaaacacttcccggcggcacccggcgatatggcatatcgcctataaccaggatgatgctaataagctgaaagatggcattggtggaagtaaaaataccagtgacaacgatagtaccactttagattttaaggatgccttccggggccagtatgaactggtcacgccagccgtcaccttctaccagtcatttaaaaatgattatgcgccaggagccggaccgaaaacgaatattgatcaactgtatatagataccaacgccgagaagaactataaggcgctattatcagaacccggtgtgatcaggttgccactacaaacctgcccgcgagtggatggcaagccatctaacgcagaaagcaaatcagcgaatgccccattgctggcccgtaaactctatccacgcttgtcggtcgccatttcatcagtagcggcagacgataataaagagatggatgagcgtgggtataccgactatacccagcagggcgcggtgcgagctaatacgaacgcaaaaggcaatccggcaggagcgatagccggtgtcgcggttcaggcaaatatcgtagtagataaagacgatgccactgaagctgacagggcgcttctgaaagaagaaacaacaggtctttttgacgactggatttctgatatttggtttagcggaaaggatatttaccataaaccattttggttaatcagcgcgaccgcagcaactatcgatccggatggtaatggtaccaataaaatcaacccgcagtcattgtcggtcattattacccagtggtgcagcactatcccgcagggtgggattatatcttctgatgcagcatataactgggatagcaaagaaccgcataaatttttattgcactctgtcgtagcagaagatacagatttgaagttctacaacgacagtgatagtgaaatcgattttcctgaccatgaaagaattacctattaatcattggaagaataaaatgaaaaaaacatggattattaaggccgcggtaactgccgtaataggggggcagatcgcctttgcgggtgccgcaaccgcatcaaagaatgccgacgcgggcctgctggtcacaacaccacagcctgctcagccgacagcacgtaacccgttttccggcagtgaagcggtgggcgttaccgcgccagtcagcaaacccgttgtcgtaccggcgccggaagtaaaactggtgctggttgaagaggaattgctcagccagcaactgtcgaaatgggcgcagcaaaatggctataagctgctgtggaacagttccacagattttgtcatttataaagcaatcaacctttccgggaagacgacacaggatgtattagtgaagctgggaaaggtttttacctctgagaattatggcttagtgatcaaagactatcaggccaaccacgtactgatcattgatgaacagtaataaacgcaagggaatgatgctatgaatattaaagtttcgcttctggcactgacgctggccattcagggctgtacgtcttttgatacgaaatacaataaagataatgttttaaaagagacgggtaatccaactacaccggatgagatgaaaaccaccggctacatgaaatataatgaaccctatctgggtaaaaaagtggaatttaactcccgcaaacagtccctgctgcgcaagcatgtaaaaattcagtcgtatgaagcgaccgatttagccaccattctggaggcggtttcggcgcagaccggcgtcagctatcgcattaataccaaagccggtgaaaaggcagaggcgggcgagccagaataccgcagcgtcaactttgaaggcacctttgaggagtttacccgctatatttccgcgctatatgacgtcaatccggtgctggataacaacggcgtgctggtggtttcttactaccaaaactatgtgctgaagctcgatttctacggcgaagagaataagtttgaaaccagtctcgatctgtccggcaacgaggccacctcaagcggcggcgtgaagggcaaagcggaaaccaagttcgagtccagcttctgggacgacgtggaagacatggcggagaaattcgtcagcagcggcatgtacagtatctttaaagatgcttcgatcctgactatcacggcgcgtccgtctgaatatcacgcccttaatgaggcgctgaaaaaattccaggccgacaatacgcgtcagtttgtggttacctacaaaattttcaccctcgataagcgtaaagcgaaagagctgggcggcggcattaacggcaaatttaatgacggcacgtcctcattcggtattgaaagtgccgatatgctgatgaaactttccggcggcatgtccgcaggctggacgaatcagcatatgaacatcagcgcacagctggatgcgctgtatgaattaaccggcagtaaggtattgcagagcggctcttttattacgcgcaacaatattccggtaccggtcaacatgaccaattcacaaaattatgtttccagtcgtactcgcgaagaagactcggaaacgggcgatgtggacatgacggttgagacatccgaactcatcaccggtaccagctttattctgacaccacgtgtgttaacggacggtcgtattgaggtggccagcgcctttaccaagcgttacctgcagggcattgaagttttcgatgacgtgcagttaccagctgtcagcaccactgaaacctttaatatttctaccattacgccgggaagtttattactggtcagtaaatacgaagccagagaggatgcagacagccgcggcatatccattctggaagggtcggtcactaacgatgaacataccgaaacggtagtgatggttgtcggtatcgatcattatcgcgctcctacacaaacccggtgaggcgtttatgcttgagcgtttggcagagaataacgtcctgatcaatctggtctggaattatcaaccggcgtcacatgaaccctattatctggaatgggtggcgcatttacgccgcacgcaccgacagctgaaaacggtcgatgacaacggtcaggaaatgacggcattttgtcacaaactctctacgttgtatgagccgtttgcgctgtggatgcgtgcgttgtacggggatgggatcttttactgtgaaactcaggggaattattactttctgattatttcgcagggtgcccccgtctcgggtagcgatattgtcgtgtcacggcggttctggacgatcctgaaagagcaactggctgaatcgcctgagtataaagatctcgcgctcaggaaaatcaccgaagagcatatttcaacggtgatcgaacgctgcaacgaacatcaggcgaaaatgaaaaaaaggcgtcaggtcattattggctcgctggcgttgggcggcattgttttacttttggccgtgatggtgctgctaaaaatatttataagaggataagcaggtggctgagtccaataaattatatttctggaaaagtcgtagtctcaacgtctcgtcgtcaggaaagggcacgtctgttctcgtctgggttattgtcgtgctgttactgctggtcgccgtgggaggcggagcctattactacctcgtctggaaacctgagcaggagcgtctggcgcagattgaaagagaaaaagcggcacgccagcaaaaaataaaatcggtggagaagttttatcaggactcgctcaccggcggcagcattacagatgtccataagctgttagcgcaactccatatggtgaatgatcgtctggcgatgctgggctttagccctaaagcgatgctttgtaatagtaaggattgttcccttagctatcaacttaacgccggaagaatattcactatgaccgatattcaggtggggggagagagttattcaccgagcttctcgcaaaacagtctggattatacgggcataccttctggtctgaataatcacccgtggttaaacgactggaaaaataaaaagccagtggatctgccggtatgtactgatgttttaagctacctgagtacctggaattcccttggcggcagctataacgaaatcgctctgaaaggttttccggcgtcttcggtggcaaatgatgaatccgcgctgaaaaatgcggtgatgtcatttggcatgctattcgctaactggacgatcaccataccgtctgaaatggcgatgacgaaagtatcgctattgttacaaaaacagctatttgccgatgcattcattattaaatctatagagttcaaagaaaaatcaacgcttgttaccggaggactggcatgcaaaaagggaaattaattattgcggggttgatgttgacgctgtcgcctgcgatctatgcggcagagacggcggaagtaaaacctgctgagcagattgtagaagggcaagctgcggcaacagccgaaagcgcggcttcgccgatgcaaaatcatgtcgtccagttgatggagaaggatttcagcttcgaaacgcagtatcgggaactgaataaccagctcgcgctggaaaaactgcgtagcgaactgcgtaaacttcgcggcggcaacgccgcctctgttccggtgcctgcaacgcctcttaccgcagcggaaactgattttaacgatgaacccgccgaagccggtgcggctgcgcctgccttacgggcgctactgatctctgaaattgccgggcaaaaacgcgtcgcaatttcaggtgaaggcggcggggtaaaaatggtgccactgaataaacgctttagttacggcggttatgaatatattgctcatcatcgtcagggcgatgaagtcacggttgaggttattagtcagtgatagattatatccagtttaccgaggagaatattcattctcaggagtggcaatttaaagagtatgacggcgatatgctggttgctgaacatgcggatgaagcctggttgctggtatcgacaccacttattgataatcttgctccaatgcaggcggtatttcaccgcctgctggtgacgcataatttgcagattaagggcattgcccaggttacggaacgcaattattaccagattgttgagcagctcctctccacagaaaacaagctgctggagcaggagtccagtaatacgcagcgcgcgctggaagagttactgaaaaaagccgtagcactaaaggcgagcgatctgcatatcacgcgtaacgatatggtggcggatattgaactgcgaattaacggcgttctctgtccatttatccagatgaaagcgtcacgctgcgacgaactggtcttcgtgctttataacgttgaggccagtacgcgtgacacgacctggaaccgcaatattgcccagaatgcgaatattctctattcgctggatggtaaaagctaccgcttccgttatgcgcattatccggtatttggtgaaaccagcgactgctatcacgctgtgttgcgtattattccgtcgggcctggataaagccagcgtcgccagtctggataagctgggcgtctcggatgaagagatcgtcgatcttaaacgcattctcagcaatccgtacggcgcttatatcattgccgggacaaccggttccggtaaatcgacgacgctgaaaaacctgatggaatggatgcaaatccaccgttatgacaatcgcggttgtttcctcaccgttgaagatccggtggaataccagatctacggcgcgaaacagagttcggtattaagcggcgagtctggcggttttcactcggcaattaaatcttcattacgtcgcgatccggatgtgctgatggtgggggagatccgcgacagtatttcatcaaacgcgctggccggtgcggtagagagcggtcactactgttttaccacggtacacgccgggaacattgtgtcgctgttgcagcgtctttcagcgctggggatcaccagcgataaactctcgacgccgggttttatcgcggggctgcaatgccagaaactgatcccgctactgtgcccgcactgcaaggtgcccctgcgtaccgacgttatttccggacgcgaattcccgctgtttgaaaagaatgcggcgggatgcccggcctgtaagcataccggtatcagcgggcggcaactggtgatggagtacctgctgccggtgtacgacgaactggaagccattgccgaacaaaaatggctcaaggtgtacaccatctggcgtgccaagcgttttaaaaccaccagcctcagtgaaggatttgagattaaagaaaaaaccatggcggcggtgctgaccggacgggtctgcgccacatggtttcaaatggaatttggcggagttgctcaggaagaactggaggttatagttgaaaaaattcggtaagaagcaacgtatttacctctaccagttttgtgccgacatgatagaagcggagctgccgctttatgatgcgttacaaaaactgcgcgcagagggcaagcagttacttggaaatggctttgcaaagcgactggaagcgctcaccacaaagatggcgaacaccacctcgatttccatggtatttgaaggttttgtgccggattcggaactgagcgtgattaacgcagcagaacgcagcagcagtctggcagatggttttaagacgctggttaacgtcattaaatacaacagcgagctcaaacagaaaatcgtcggcgcggtgacgtttccgctcattatgctggtgctgtcgctgattgtgattgccggttacgccgccaaagttttcccggcctttgaaagcgtggtgccggtttctaaatggcccggcgtcacccaggcgctgtacacctttggtatggcgttatgtaatggtctgtggatctatattctgtgtggatttatcgcgaccgtgatcgtcattaatatcgcgatgtccaaagtagccggtccgctgcgtaataaatatctcgatcgtattattccgttttcgacctataagcagctttccgcctcgatatttcttaacaacctggcgctgatgctgcgcaataaaattccgctgcatgatgcgttaagtattatcggtctgaacgctaaccgctggctgcgctggcacctgaatgatatgcaggaaaaaatggctaagggcatgagctacggcgaagcgctgaattctggcctgcttaacgccgaagctttgctgaatatcagcctgtacgccgcgctgccttcttttaatgaagtgctgatggcggtgtcagataagtcccgcgaaagtattcgtgtctatatcgggaaactttcaggcttgctgaaatcactttctacgctggtgctgggcggttgcgtaatttgggtctttgccgcgctctttgcgctgagtgacaaactggctgcgatgggtgccagcggttcgttttaagcaggaaaaaggaacgaaaagacatggaactgttgctgccctggctgccggggctctttttactgctggggctgttgtttggcagtctggcgaacgtcattatttaccgtctgccgctaatgatgggcatccacgagaatggcgatgacgccggggttaatctctggtggccgccgtcccactgcccgtcgtgtaaaagcgatattaaaccccgggataatattcccgtcctgagttggctgctgctgcgcggaaaatgtcgacgctgcgccgctgccatcccggcgatttatccgctttccgaactggcgatggggctggtgtggggggcgctggccttctttggcgcgccactctcgcctgtgatcctgctggcctgggcgctgctgtttctgctgctctataccgctgcggtgattgattttaaacacctgctcctgccggatgcgctggtgtttagcgtgctgtggggcggactgctgctcagcgtggcgggctattcctttattcgccccaaagacgccgtctatggcgtggtgctggcgtggctgctgctgtggtgcgtgatgaagttgtggtgcgccttctgcaaatacgagggccttggcaacggcgatgtgaagcttttcgcggcggcgggcgcctggcttggctggcagcggctgcctgagctgttgctctactcggcgctgctgggcctgctctgttatgcggcgatctatttcgttacccgtggcgacggcgataaacgacctgtctacattccttttggcccggcgattgcgcttaccgcctttacgctcgtcattatcgggaggtagccagtgccctgtttgatctggagcctgtggctcagcatcgcgccgttatccatcggcagctgcgatcagcagcaggccaccactgctttcacgcctttgttacagcaggcgctgccgcagtccgatacggcagcgccttccagtagcataatcaccgatgaggtgcgctttgtgcaccccatagagaaaaaggtggcagtcagctccgcttttggcctgcgccgccacccgattctggggcgttatatcgaacataaagggatggatctgccggtgccgatcggcagcccggtgatgtcggtggcggatggcgtggtggtggagcgtgggcacgatcgccgcgccgggaactatctcaccgtgcggcacaatgacggctggtacagccgctatttacatctcaatacggtgactgtgcgtaaaggcgatcgcttgtctgccggggaaaccattgccacctccggtaacaccgggttatccaccgggccgcatctgcatctggagattggctataaaggcgtcgcgcttgatccagcgccgctgctcagcggcagcccgatgctgctggcaagccgcatgcggcacgaaatgccttccgcaaccgtcccggcatcgccgcgagtggtaatgatttcgcagggggagggcgggacgcgcgttaccgtccgctttaaccataaaacccgcaccgtcacgcccggcagtaaggtgttcggcgcgtatcgggtcgttcaacagcacaatggcaaatatcaggttgtttccgcggcctgatgaaggagttatttatgaaaaagacaggaatcgtcgttggcctgcttaccgccatcatattaagtagcagcgcgatggcggccgatgaacccaatgctggtcgttttagttttcagaagcgtacgcccgagcctaaagaccattttatcacgctcaaaatccagatggttggaagaatgcctaatgattccggcggtaatcaggtgctgggcgttaatgtttactggaaaacaaaggataaaaatcagctacagggaaggagcgtttattcatcgctacagcccaatttaccgcgggctggcaagaatttttctgatacttattatgtcgctcataataggcatgagtatgaaggtaaccacgaaaatatcgagtggctggtctgggaaggcgtgaacatggattgggattttgataacggctgccctcctacgcccggcaatagttctacccggttttacaatcatcgtttcaaaacttatgaaatcacaggcgtggtcccggccacctgttcggctgacgctgtggtgagtcccccgcagggtgaagatttggatgttgcattaacctcgtttgcggtgtcatttaatagcggaatctgtaaccgcatgggcgagttttgtatcggtgcaaaaagcggctcaagtaccactttcgcaaaagatatttatatcccttcgtataagctggaattccttgtgattgaagttattggctttgaatacaataccaatacggggggcgccaatcagtcgttttatattctgcccatagaggcgctgaaatttacccccacaggcgagccgggtaatccgggaagaatgaatttactgaggggcgatcgtagtccggcagggggcgaattttcagcatttggtgtgtccggatatacgcagggcggcgaaggcgaaataaggggctattacaacgcacaggacagccatttctaccagaatgacgaaagaacggcagcctgtggtcagttaagcacttctccctgtacttacgatttctctaatctggatacattgattcttagcctggagtatacaaatccacataagatccccaaatgggaacaaccttttggaagtggcgtcatatttaccctcgaacccaggagttttacctggcattgcatggaagaacgcagccagtgtactttccctcctcgtaagtaataaaaaaaggcagcgtcagacgctgccctttttctttcccggtaagagcgattaacgcatcgcgcgtttcagaatacgttctgcctgacgctggaagtcagcggcggtttcttccacgcttttctggccgtagtcgatatactgcaatgcggtcccgaactgtgccacgatctgcggatcgtcaaagtatggcgataccgtcagtttcgatggcagagactgcgccaggcgcagacccgcaaccgccggatcttcttctttaatcgcgccgctggcggtcagggtttccaccgccgctttactcagcggtacaccgcgctccagaccgagggtttccgcgccttctttgctgttcagcaggaagttaatcagctcggctgcttctttcggatgcttagtggatttaccgatagagagcatttgcgccggtttaaagaacaggcctgcgtcggtggcgccgtccagcatcggatagctgcccagttccagcttcgccggtggcttcaggttgtcggagtatttggtgatggtggagttccacatataggtgccgccccattccccttcgatccagggtttcatctcatacatgttgctcttcccgaaggacgcatagtacttggtgtccggcatcacgtggctgtcgaccaggttcttataggtctggaagaactccacccactgctctttgctgtaggcgaattttttggttttctcgtctaccgccggaatgttgtatttctggatcatgtacgagttcagcagcgccagcgtatcctggtgctcaagcaccaccgggtaatactgtttacccagcttgctttcaaaggttttgcccgcggctttcagctcgtcccaggttttcgggtaggcgacacccgcttttttccaggtctcatcgttgaaatagaagacgcgcgccgtgacggagatcggaatgccattcagcttgccgttaacggtggtgcttttcagctctttcggatcgaactggcttaagtcaataacgtctttcacctggttcagatcgtagaagccgtcaccggttttggaaaaaatcggcagccagttccagttagtctgcatcacgtcaggctcggtgccgccggcgatctgggtggtcaggcgggagaggtgaccatcccagccggtgtactcagatttcacattgatgttcgggtgcagcttgtgaaactcttcaatcgctttcagggtgacctggtggcgaccattgccgccccaccaggacatacgcagatccacattgtccgcggcgtaagaaggtaaggcacagagtcccagagtggcggagatcgctgcgcttaaaagcacttttttcatttttatgctccagtttagagagagatgttctgttcggttttcgcgtcaaaaatatgacacttatccatgtcaaacttgaagtacaccttacgatgtaaacctttcgctatcatcggtttggctacatcagaaggaatgcgggcggtcagttcatagttaccaacgcgcaggtaaacaaagaattcatgacccatgttttccacgcgcaccagatcccctgaaccgtaaccttcggcaaaaggctcgtcggagacggagacaaattccgggcgcacgccaaagaagacgtcctgatcctgataattggccactttttcgcgctgtttcgcgttcaggggcagcgtttcgtcgccaacggtgatgtgcagatcttcaccttttctgacgatttttcccggtttgatgttcatctctggcgcgccgataaagcccgccacgaacatgtttttcgggaagtggtagaggttatccggcgtatccacctgcatgatgtgaccgagcttcatcacgcagatgcggtcgcccatggtcatcgcttcggtttgatcgtgcgtcacgtagaccgtggtggccggtttgccggactgtttcagctgtttgtgcagatccgaaatacggatgcgcatcgaggcgcgcagcttggcgtcgaggttggaaagcggttcgtcaaacaggaaaacgtccggctttttcacaatcgcgcggcctaccgccacacgctgcgcctgaccgccggaaagctgacgcggcagtctgtccagcagctcctccagctcaaggatttttgccgcttcatccacctgtttatcaatctgatctttcgggattttgctcagcttcaggccaaaggccaggttctcgcgcaccgtcatatgcggatagagcgcatagttctggaacaccatggcgataccacgcgctttcggcgcgagattgttgaccacgcgctcgccaatacgcacttcgccgccgctgatggtttccaggcccgccagcatacgcagggtggtggacttggcgcagccggatggcccgacgatcaccataaactccccgtcagcgattttcaggtcgataccatgtaccgctttgaagccgttggagtacactttttccagtttgttgaaaataacttcagccatgatatttccctcttaacctttaattccgctgctggtaacgccctgcacgaagtagcgctgagccaggaagaacacaatgatggacggcagaatggagatactcgccattgccagaatttcgttccacggcgcgccttcagtgacgtcgatggacattttcagcgccagggcgatcggatatttgtccacgctgtagacgtagatcagcggcccgataaagtcgttcattgaccacatgaactggaacagcgccacggagataatcgccggtttcaggatcggcaccaccacgtaccacagtacctgcgccgagttacagccatcgatctgcgccgcttcttccatgtcgcgcggcacgccgcgcaggaactggatcagcatgaagacgaagaacccttgcgtggcgaacgcggtcggcagatacagcggcagatagctgttcagcatgcccatttcacggaacatcaggtactgcgggatcagcagcacggtgcttggcagcaacatggtggcgataagcgtcgcgaaccagaacttcttccatggaatttcaaagcgcgcaaaaccgtaggccacaatggttgacgagatgatggtcagcagcactttcgggatcacatatttgaacgtgttccacatgtaatggccgaaggtgtattccgtgccggttttccagccgttcacaaagccgtcgctggtcgggtgggcaggccacagtccgagcgtggtgaagatctcgtggttcggtttgaacgacgctgagaacatccacgccagcggatagagcatcaacaggccaacaaacagcaggatcacgtagcggatcgcggcgctgatcttctctttacgctgcgtctgcgccacttcgcgctctgcgtctgtcattgcaggcgtaatttgttgtacgtcagccatttttgcctcccttatcggcggagtagaacacccagtattttgaagatttaaaggcgacagaggcgaagagtgccacgaccaggaacagtacccacgccagcgctgcgccatagcccatatcaaagtacttgaaggcggtgtcgtagatatagagcgagaacaggtaggtggagtaggtcggcccgccgccggtgatcacgtatggcccggtaaattcctggaaggcctgcgtggtctgcataatgaagttgaagaaaatgaccggcgtgatcagcggcaccgtcactttcatgaacatctgccatttggatgcgccgtcgatcattgccgcttcatactgtgattgcggaacgttttgcagtgcggcgaggaaaatcaccattgccgagccaaactgccagacgcgcaacagggtcacggacatcagcgccagcgacggttcgcccagccagttaatgggatccagaccaaacacgccgataaagctgtttagcagaccatcaatggcaaagagcgcgcgccacagcacggcaattgccacagagctgccgaggatcgatggaatataataagcggtacggaaaaaaccgatgccgcgcagtttaaagttcagtacaaacgcaatacccagcgcgaaggccagcttgagggggatggttaaaaatacataggcaaaggtcacgcccatggatttccagaagagagaatcttctgtcagcatatagcgatagttttctatgccgttaaataccggcgggctcatcaaatcgtactcggtaaagctgagtacaaaagatgaaacgaagggaaaggccgtaaagataatcaaccctatgatataaggtgaaatccaggctaatcccagtgctctgttttcattcatacatacctacctggcgatcaatggtttaaaacggaaccggagatttctggtgcccgcaccggtaaggcgaaggcgtaaatgtgcaaaatctttgcccttttccatgggcggtgtgaatgagttttaaaatcttctgaactcgcgttcttgatttgtaaaacatcgttttaatttattttattgtgatttgttacggcgtcattcgattaatcatggaaatgtgatcagagtcgaaacgacgtttcaataaggtgaggtgtgtgtcatttctgcgaaaaagatctgatgtatagacagggcgaatgacatacagaacatgaataaaacaaggcgcagccagaaatagatcaccgctaaaatcatttacagactaagtatttagcgcgtcggcataaataaaaacgccctccgtgcagagggcgctttaaacagtggcgggctatcagcttttaaggaaatcttcccgtaccggcgtgaaggtgtcgagcagcgtaccgggcttcaggcagacgcagccgtgcattacgtgcggtttcttgtaaagtgtatccccggcgctgacgatatgtttttcatcgccgatggtaaattcaaattcgccggagagcacataggtcagctgttcatgaggatggttatgaagcgggccgaccgcgccttcttcaaaattgacttctactgccatcattttaccgtcgtgcgcaaggatacgacgggtgacgccgttgcccaaatcgtcaagctgagtgtctttatggaaaataaacatcggatcgtcctgtagtcagtaaattgcatgaagtaaaacattgtttcattaaatttatatcagccagagctaaaaagaaacgccagagccggtgaagtggaaagccgatcacatattgttttgacgataacgtttaaggggaaaaagatgaaaacgataggcttgctcggcggtatgagctgggaatccaccattccgtattaccgcttaattaatgaaggggtaaaagcacggctgggagggctgcattccgccagcctcctgttgcacagcgtggactttcacgagatcgaagcctgccaggctaacggcgactggcataaggctggcgtgatgctggcggaagcggcggcggggcttgagcgcgcgggcgcgcagggtatcgtgctttgtaccaacaccatgcataaagtggcggggcagattgaagaccgctgtcaggtgccgtttttacatatcgccgatgccaccgcccgggcaattcagcgcgccgggctgaaatccgtggcgctgctcggtacgcgctataccatggagcaggagttttaccgtggccgactggcgcacaattttgggattcaaaccacggtgccggatgcggacgatcgcgggcgggtcaatcagatcatttttgaagaactttgcctcggcaccttcagcgagccgtcgcgtgactatttccttgggctaatcgcgcgcatggcggcggaaggggcgcagggggtgatattcggctgtactgaaatcgaactgctggtgccggctgaccagtgcccgatcccggtatttgacaccgccgcgctgcatgccgccgatgcggtggagtttatgctctcttaaggccgcgccagcaccgcatccagcggttcggtgatgcgcggcatggaagattgcagatgccgcgcaaaggcttccaccagcgccgaggcggggcggtgcagcgggcggatcaggctgacggtaaaaggcacgtcaatgctgaaacgcctgaccactacgccgctggcggcataatccagcgcggtcagcggatttaccaccgacacccccgcgcctgcccgtaccatggcgcacaccgacgccgcgctgtgcgtttccactaccatccgccgcttcacctgatgctccgcgaaaagcgcgtccagcaactggcgatagctgtcggtacgcgacaggctgatgtagttttccccctgaaaatcctccggcgtcagcacggttttatgcgccagcggatgatcctgcggcagtacgcacacttcgttaagcgtcagcagcggcgtgcgcccggtgcctgcgggcgtgctcaatgtctccgtcagccccagatcgtgacgctgcgcggacagccactcctccagcagcggcgactcctgcggtaccacgttgaggctgacctccgggtagcgcgccagaaagggttgcagcagcagcggcagaaacgactgggagaacaccggcaggcagaccaccgacagctccccctggcggaattcccgcaggctttcggcggcgctgacgatgcggtccagcccgtaccaggagcgttgtacttcttcgaacaaccgcagcccctgcaccgtgggatgcaggcggccccgcgtgcgctcgaacagcgtcaggccgatcaccttttcaaagcgcgccagctcacggctgacggtgggctgtgacgtctgcaacagccgcgccgcctccgtcaggttgccggtggtcatcaccgcgtgaaaaatttcgatatggcgcaggttaacggcgggcatgacaggttcctcatacaacatattcccatatcataaatgaatagactcgcgataaaacgatattttttatccggttcgcgttgtggcgtaatagctaaaaattattaaccggagccacctatgccacgctcacttaacaacaccgacaccgcccttaacgccgcgaacctgctggcgctgccggccctgtacggctgcccggtctgggcgtacgacgcgcagatcatccgcgaaaaaatcgcccagctcagtcagttcgacgtggtgcgttttgcgcagaaggcctgctccaacgtgcacattctgcgcctgatgcgcgagctgggcgtgaaagtggattccgtgtcgctgggtgaaattgagcgcgcgctggtggcgggttacgagccgcagaccagtcccgatgacgtggtcttcaccgctgatatgatcgacgccccgacgcttacgcgggtgcatgagctgcaaattccggtgaatgccggatcggtggatatgctgcgccaactgggggaagtctcgccagggcatcgcgtctggctgcgggtgaatccgggctttggccacggtcacagccagaaaaccaataccggcggcgaaaacagcaagcacggtatctggtacagcgatctgcctgaggcgctggaggtgattaagcgttatcagctgaagctggttggcctgcatatgcatattggttccggcgtggactatgggcatctggagcaggtgtgcggcgcgatggtacgccaggtgatcgagtttggtcaggatctggaagccatctccgccggtggcggcctgtcgatcccctatcgcgaaggggaagaggccattgatacccaccactattacgccctgtggaatcgcgcccgggagcagattgcggagcatctggggcatccggtcaagctggaaatcgagccggggcgtttcctggtggcggaatccggcgtgctggtggcgcaggtgcgcagcgtaaaaagcatgggtagccgccactttgtgctgatcgacgccggttttaacgatctgatgcgcccgtccatgtacggcagctatcaccacatcacggcgcttgcggcagatggccgtgatttaacaaccgcgcccttaatggataccgtggtggccgggccgctgtgtgaatccggcgacgtgttcacccagcaggagggcggcaaagtggaaacccgcgcgctgcctgcggtggtgcccggggattatctggtgctgcacgataccggcgcgtacggggcctcgatgtcctctaactacaacagccgtccgctgctgccggaagtgctgttcgagggcggcgagccgcgcctgatccgccgccgtcagaccatcgacgaactgctggcgctggaattactttaagcttttgaaatgcgggccgggggcgaccgaatcgcgcagtaccagcgtgccggtaaagggcgggatcgtctcaatggggcgatccgccgccagccgcatcgcctgatcaatggcggtggtgatcatgatgtcgataggcagacaaaccgtcgacagccccggctccagccatctggcgctgggggcatcatcaaaaccaaacagcgaaatatcctgcggaatacgcagcccggcctggtggatcgccttggacgcgccgagcgccatatcatcgttacaggcaaagagcgcgctgaaggcaacgccttcctgcaacagtgcctgacactgctcatagccgctggtcatacccgcatcgccatacctgactttcgccgcatcccagcggataccgtgcttttccagcgctttgcggtagcccatcagccgcgctttgccggtgggcgtgtggataggtacggtaatgcaggcgatatcgcgatgtccctgagaaatcagatattccaccgccttaaaagccgcgtcctgctgctcgaagaatacgcatttatcccgcgcctggctgacgtcgcggttgatcacaatcagcggcatcgggatgcgatcgataagcgccataatggctttttcgcgcataaagcgggtgtagagcacaatggcgtcgcagcggcggtccgccagcatctgcaccgcttcttcttcccgctccggggtatcgtgcccgtcggtgacaatcagctgcttgccgtgggtttccgtctggcgggaggcctgctgtaacaggcgtccaaaatagaagccgtcaaaggtcgataccaccaggccaatactgttactggtgcggttggccagcgactgggccagaaagttaggccggtagcccagctcttccatcgctttaaacacctgctgccgggtgctgtctttaacctgacctgtaccgttcagcacgcgtgaaaccgtcgcctttgagacgcccgcgcgcagtgaaacatccagcattgttgccatgacgacgtcctgtttcctgagttgagcgggagtttatcacaaaggctatatgacgttacggcctctccctgtggaaaagcgatgggtggaataccaatctacgcgcgatcacattatctggaataccactttctatcctgagagctttatcacagaacttttcccctacgctgtctacttttggtatgccagttggtattcggctgtaaccctggacaataaaaaagcccttttactgaggtaccatcgtatggctttacaggataagctcattgattctctgggtagtttcgcgacaacttttaacagttatcgctatattatggcgattaaatccgcctttattaccctgatgccggtcattattgtcggtgcgttttcagtactgatttccaatatggtgctggatccgaaaaacggtctcgccagttttcagtcgctgtcatttctggcggcgttaaaacccattaccagcgccattaattacgccacgctcaacttcttaaatatcggcgcggtatttttaattggtctggaattagggcgcattaacggcattaaatccttattccctggcctgctggcggttatttgttttatctgcgtgacgccaacgaccgtagaaatgctggtggacggcgaaatgcatgtggtgaaagacgtgctgctgcgtcagttctccgatacccgcagcctgttcctcggcatgtttatcgccattctgtcggtggaaatttattgctggctggaagggcgcaaggggctgaagatcaaaatgcccgacaccgtgccgcccaacgtcgctgcgtcgttttcggcgctgatcccggcgatcatcaccaccaccgccatcgccaccttcggattcgttttccatcaaatcaccggcttgtatctctacgacgccatctatcaggtggtgcaacagccgctggagcgtgtggtgcagagcctgccggggatcctgctgctgatgttcgtggcgcagctgttctgggtgatcggtattcatggtaaccagatgatcaaaccgatccgtgagccgctgctgctgggggcgatcaccgtcaatatgagcgctttcgaacagggcaaagaagtgccgaacatcatcaccatgccgttctgggatgtgtacatgagcatcggcggttccgggctgaccatcggcctgctgattgccgtgatgatcgccaccaaacgtaaagagatgcgcgagatcgccaagctctctatcggccctggcctgtttaacatcaacgaaccggtgattttcggcatgccgatcatgctcaacccgatcctcgcgatccccttcatcatcacgccgctggtcaccggatccattggctatttcgccaccgtcaccggtttcgccggaaaagcggtggtaatggtgccctggaccacgccgccactgatcaacgcctggctctccactgccggatcgatgggcgcggtgatcacccagtttatctgcatcgttactgcggtaattatctatctgccctttgtgaagatcgcctcgcgccgcgcggaacaggcgcagctgaaggcggaagcaacggaactggcgaaaaacgcctgaggacagtatgagcacgaaaaccatcgttatcccgccgtcatttatcctcggggcggcggcctccgcctggcaaaccgaaggctggagcgggaaaaaagccgggcaggactcctggccggatctctggtacaaaaacgaccgccacgtctggcatgaaggctacggcccggctgtcgccaccgattttcatcatcgcttccgtgaagacgtgcagctgatgaaagcggcggggctgacccactaccgcacctcgatcaactggtcacgcttttttaccgactacgagaatggcgtggtggatgaggagtacgccgcctggtatgacgaactctttgccgagatgcatcgccacggcatagagccgatgatctgccttgagcattacgagctgcccggttatctgctggaaaactacggcggctgggcgtcgaaaaaggtggtggagtttttcctgctgtatgcggaaaaagtctttgcccgctatcacacccaggtgacgcgctggttcacctttaacgagccgattgtggtgcagacgcgcgtctatctggacgcgctgcgctggccctatgaacaaaacaccggcacctggatgcagtggaatcacaacaaaaacctcgccacggcgaaagtggtgaaactgtttcgtgagaagggctatcagggcagcgtcggctgtattcttaatccggaagtgacctacccgcgctctcgtgcgccgcacgatgtgcgggcggccgacatgtacgatctgttctacaaccgcgtgtttctggatccgttagtgaagggtcattatcccccggagctgttcagcctgctggaacagcatcaggtggcgtgggagtacaacgacgaagaactggcgatcattcgcgataataccgtcgatgaactggggattaatctctattacccgcaccgcgtgaaagcgccgtcccgcgcctggcatccggacacgcctttccatccggcatactattacgagccatttgaattaccggggcggcggatgaataaatcccgcggctgggaaatttatccgcagattatttacgacatggcgatgcgcattaaaaacgactacggcaatattccgtggttcgttgccgaaagcgggatgggcattgaaaacgaggggcagttccgcaatgtcgatggcgtgattgaagatgattatcgcatcgcctttatcagcgaacatctttaccagacgctgcgcgccagggaagacggcgctaactgccagggttatatgctgtgggcgttcaccgataacgtctcgccgatgaacgcctttaaaaatcgctatggtttaattgagatcgatctgcaaaataaccgtaaccggcgcgccaaaaaatctgcctcatggtaccgtcggttaagcgaggagcgcacgctcacgctgactctcgacgatgaatggaaatagcaggtgatatggtggagaaagcagtcgtagtgacggaaaaaaaacagtaccaggagataggtgaggatctgcgcgcgcagattatccagggacactacccggtaggctcccgtctgccgccggagcgaaatattgccgaaacctacggcgtcagccgcaccatcgtgcgcgaggcgctgttaatgctggagttgcagggcacggtggatatccgccagggatccggggtgtacgtgatgcgcatcccccaggagcacgaaaacgaagaagaacgctttttaagcagcgacgtcggcccctttgaaatcctccaggcgcggcaactgctggagagcaacattgccgcctttgccgcaaaaatggccacccgcgccgacatcgacaacctgcggcgtattctggagcaggaacagcgcgccatcgccatgaatgacaattcccaggataacagcaaaatgttccacctggtgctggcaggggcgtcacaaaaccagatgctgctgggcacggtggaaagcatctggcatcacatggacagcagcccattgtggcagcagtttaatgtgcacatcgccagccgggcatatcgtctgaaatggctgggcgaccgccaaaccctgctggcggcgctgcgccgtcgcgatgtgatgggggcgtggcaggcgatgtggcaacatctggaaaacgtcaaaaaaagcctgctggagctatcggacgaagatgcgccggacttcgacggctatctgttcgaatccgtaccgctttttcagggaaaattaatgtgaagatccagccgctttacgacgtgccgcagtttaccggacaggtgatcgactggcagtggcgcgcctttggcgacgggctgccgcgggaattttttgccagcatcgtcgaacacagccagcgtcccggcgagctgccgctgaccttcgtggcgacggagggtgagcagttgctgggtacggtgggactctggcgctgcgatttaatcagccgtcaggatctgtggccgtggctggcggcgctgtatgtggatgaaagcgcgcgcgggcaggggctggcgggggcgctgcaacaacaggtgatagagtacgcccgcgggcagggctatccgcagctgtatctgtggtctgcctgcatggatttttacgagcgctacggctggcagtacattggcgacggccttgaatacccggacaaaaccgtgcacctgtaccgctatacgctttagctttcctgcaacgtgccgaccgagtggcgtcgtaccagcgtcgggttaaagacgtgggtaatatccggcagcggacgattttccgccagcgccagcgccagttcagcggcctgggtcgccatggtgacaatcggatagcgtacggtggtcaggcgcggacgcacgtagcgggagatcagaatgtcatcaaagccgatcagcgaaatctcacccggcacgtcaatgccgttatcgtttaacacccccatcgcccctgccgccatggagtcgttataacaggccaccgcggtaaagtttttgccgcgtcccagcagttcggtcatcgcctgttcgccgccgctctcgtcaggcgcagcccaggtcaccagccggtcgttgcacggcaggccattttcccgcagcgcgtcgtaatagccctgcagtcgatcttccgcatccgaaatggcgtgattagagcacagatagccgattttagtgtgtccctgctggatcagatggcgggtcgccagccaggcgccgtaacgatcgtccagcgccacgcagcgcgtttcaaagcccggcacgatgcggttgatcagcaccatgcccggcatctgttccatcagggcggcgagatcggcatcggggatcattttggcgtgcaccaccagcgccgcgcagcgatggcggatcagttgttcaatcgcctgccgctctttgtgttcgttatggtagccgttgccgataagcagaaaattgccggtgttataggccacatgctccacggctttcaccattgagccaaagaagggatccgagacatcgcccaccaccagcccgacggtttccgtcgactgctgcgccagcgcgcgggcattggcgttcgggtggtaattaagggattccatggcgctctgcaccgccaggcgcgacgattcgctggctttcggggagtggttgatcacgcgtgacaccgtggcaacagaaacacctgcaagccgggctacatcctttatcgtcgccatacagaaccttctttttgggtaagcgtttacacagcgttaagtgttacggaaaagcgccgtctgttcaaggcgattgcggtacgggacgccgtaaacgtgatcgacagcctactgcggctggtgaaaacgttacacgaggtggttgacagcaaataagacaaaaaaagcgaattcaaacctttggttacactttgcgaagggctgttgcgattgattactgtagggacaggggggctgttgctacagttaaagtcccagaggtattgattggtgagatttcagtacgttttgagtactcacgttttgcaccaacctgcgcggatgcgcaggttttttttcgtctggattttaccttcgccccttctgcacttctcgtgtaatctgccacaattccctgacatctttcatattaactgacacaggaagttgccatgttactggactttttccgttttttattccgcctgttgttcagggtcgaactgaccggcgatacccaggcgctccgcggtgagcgcgtactgatcacccctaatcacgtctcttttcttgacggcgttttgctggcgctgtttttaccggtacgtccggtgtttgcggtttacacctccatcagccagcagtggtacatgcgcgccctgcgcaatctgattgattttgtgccgctcgatcccacaaaaccgatgtctgttaagcagctggtgcgcatgattggccagggccgcccggtggtgattttcccggaagggcgcatctcggtgtccggatcgctgatgaaaatttatgacggcgcgggctttgtagccgccaaatccggcgcgaccgtggtgccggtgcgtatcgaaggcgcggagttgaccttcttcagccgcctgaaagggctggtcaaacagcgcctgttcccgcgcattcatatccgcatcctgccgcctacctcgctgccgatgccggatgcgccgcgcgcccgtgaccgtcgtaaaatcgccggcgaaatgctgcaccagatcatgatggaagcgcgtatggccgtgcgcccgcgtgaaactctgtttgaagcgctgcttgcggcgcaataccgttacggcgcgaacaagccctgtattgaagacatcaacttcaaaccggactcctatcgcaagctgttaacgaaaaccctgttcgtggcgcgtattctggataaatacaccgcgcagggcgaaaagatcggcctgatgctgccgaacgcggccatcagcgcggcggtgatctttggcgcggtcgcccgcgggcgcgttccggcgatgatgaactacaccgcaggcgtgaaagggctgaccagcgccatcaccgccgcgcaaatcaaaaccatttttacctcacgcacctttatggacaaaggcaagctctggcacctgccggagcagctgacgcaggtgcgctgggtgtatctcgaagatctgaagggcgacgtgaccctcgccgataagctgtggatcttcgcccacgtgctgatgccgcatctggcgcaggtgccgcagcagccggaagacgccgcgctggtgctgtttacctccggctcggaaggtaatccgaaaggcgtggtgcacagccataagagtctgctggcgaacgtcgagcagatccgcaccatcgcggattttacggctaacgaccgctttatgtcggcgctgccgctgttccactcctttggcttaaccgtcggcctgttcacgccgctgctgaccggtgcggaagtgttcctctacccaagcccgctgcattaccgcatcgtgccggaactggtgtatgaccgtaactgcaccgtgctgttcggcacctccaccttcctcggccactacgcacgtttcgccaatccttatgatttctatcgtctgcgttacgtggtggcgggggcggaaaaacttcaggagagcacgcggcaaatctggcaggacaaatttggtctgcgcattctggaaggctacggcgtgaccgagtgcgcgccggtggtctccattaacgtgccgatggcggcgcgccccggcaccgtcgggcgcattctgccgggtatggacgcgcgtctgctggcggtacccggcattgaagacggcggtcgcctgcaactgaaagggccgaacgtgatgaacggctatctgcgggtggaaaaccccggcgtgctggaagcgccgacggcggaaaatgagcgcggcgagatcgagccgggctggtacgacaccggtgacatcgtgcgttttgatgacagcggctttgtgcagatccaggggcgcgcaaaacgctttgccaagattgcgggcgaaatggtgtcgctggagatggtcgagcaactggcgctggcggtatcgccggaaaaaatgcacggcacggtgatcaaaagcgacgccagcaaaggcgaggcgctggtgatgtttaccaccgacagcgagctgacgcgcgacaagctgctccagcatgcccgcgcgcaggggatccctgagctggccgtcccgcgggatattcgctatctgaagcaacttccggtattgggcagcggcaagcctgattttgtcacccttaaaggtctgcttgaagacccggaacatcatcatgcgtgagtcacacactaacaattccctgtggtcgaaggggatgctggcagtcaccgccgcgcagttcctgtctgctttcggggataacgcgctgctgttcgccactctggcgctgctgaaagagcagtattacccggactggagccagccgatcctgcaaatggtgtttgtaggcgcttacatactctttgcgccttttgtcggccaggttgctgacagcttccccaaaggccgcgtgatgatggtggcgaacagcctgaaactgctcggcgcggcaagcatctgtctcggcgttaacccgtttattggctatacgctggtgggaattggcgcggcggcctactcgccagccaagtacggcattctcggcgagctgaccaccggcgataaactggtaaaggcgaacggtctgatggagtcctccaccatcgccgccattttgcttggctcggtagcgggcggggtgctggcagactggcacgtgctggcggcgcttggcgtctgtgcgctggtgtacgcgggtgcggtggtggcgaatttgctgatcccggtattgcctgtcgcccgtcccggccagtcctggcgtttcgtgccgatgaccaacagctttttcagcgcctgccgatctttatggcagaacggcgaaacccgtttctcgctggtgggcaccagtctgttctggggcgcaggcgtgacgctgcgcttcctgctggtgttgtgggtaccggaggcgctgggtattaccgataacgccacgccgacctatctgaacgcgatggtggcggtggggatcgtgttgggcgcaggcgtggcggcgaaactcgtcaccctggaaacggtgtcgcgctgtatgccagccgggattttaattggcgtcggcgtgctgttcttctccctgcaacatgcgctactgcctgcctatggcctgttaattctgattggtctgctgggtggattctttgtggtgccgctgaacgcgctattgcaggagcgcggtaaacgctcggtgggcgcggggaatgccattgcggtacagaatctcggtgagaacaccgctatgctgctgatgctggggctgtattcgctggcgataaaagtcggcgtgccggtggtgggcgttggcgtgggcttcggtgcgctctttgcgctggcgattgccgcgctgtggatctggcagcgtcgtcggtaaagaagtctgggatacgtaggccgggtaagcgcaagcgccacccggcaaaaaaaagccgggcatctgcccggctttttacatcacggtgccggataggtatacacccggtgcactgcttcaatctctgctaacacgtcctcactgagatcaagatggaagctctccacattggtcttcagctgtaccagcgtggtcgcccccagcagggtgctggcgacaaacggctggcgacgcacaaaggccagcgccatctgcgccggatccagattatgccgcttcgcaatatccacgtaagcggcgactgctttttgcgactgctcgccgctgtagcgggtaaagcgactgaacagggtattacgcgcgcctgccggtttcgcgccgttgaggtatttcccggtcagcgtaccaaaggccaggcaggaataggccagcagctccaccccttcaaactggctgacttccgccagcgccacttcatagctgcggttcagcaggctatacgggttctgaatggtgacgatgcgcggcagatcgtgcttgtccgccaggtgcagataacgcatcacgccaaacgccgtttcgttggagacgccaatgtaacgaattttcccggcacgctggtattccgtcagcgcttcaagggtttcaaggatggttacacccggcgcgctatccgtccactcatagcccagtttgccgaagcagttggtcggacgctgcggccagtgaacctgatagagatcgagatagtcggtttgcaggcgttttaagctggcatccagcgcctggcggatattttttcgatccagcgcctgatccgggcggataccgctgtcgctgttgcggctcgggccgctgacttttgaggcgataacgagtttttcgcggttaccgcgtttcgtcagccagttgccgacgtaagtctcggtaagcccctgggtttccgggcgtggcggaacagggtacatctccgcgacatcaataaaatttattccctggcttacggcataatcgagctgtgcatgggcgtcggcttcgctattttgttcaccaaacgtcatagtgcccagccccagagtgcttatctcaagggagctgtgagggatacggtgatagtgcatttgccggcttccttttgttaacaacgtcagtcgcttcctgacaaaggaatataaacatggcagaggggagtgaaaagggaaagtgaaaaatcaaaaggtcagcagggtactgaccctttcaggattaacgttcgataatctgtgaaacgtcgtcgcggttgatctgcatctcgttgccctgctgatcgcgatagctaaccagtccggtgtcatcatcaatttgtggtttaccatctgtcaggatcattttgccatctttggtcgccataacgtaatcactgctgcaccctgaaaccgcaaaagccaggcctactgcagagatcaccactgcccattttttcatcgttttattcctcgcgtgacggttaactgaatgtagtctagtaataacgcagaataatgtgatgaaaaagcagcaaattctgaaagcggaagaaaaaatgtacactcccccgggggcgggggagcggtaaatcagagcggacgcttcttgttgcgcaacagattgagggtttccacggcaatggagaagaacattgcgaaatagatgtagcctttcggcacgtggatgccgaaactttccagcatcagcgtaaagccgacgaggatcaggaaggccagcgccagcattttcaccgacgggtgacgatcgacgaattcgccaatcggacgcgccgcgaacatcatcacgccaacggcaatcaccaccgccgccatcataatgaacagatggtcagacagtcccaccgccgtaatcaccgagtcgagactaaagatgatgtccagcagcatgatctgcacaatcgcgcccataaaggagtggacgttggttttcagtccttcctcttccccttcaatggactcgtggatctctttgctcgctttccagatcaggaataagccgccaagcagtaaaatcagatcgcgtgccgacaccgcatggcccatcacctcaaacagcggcgtggtcaggcgtatcacccatgcgattgaggccaacagcgccagacgcatgatcattgctcccgcaaggccgagacggcgggcgcggttacgttgtgcgggcggaagttttgccactaccagagaaaggaaaataatattatcgatacccagcactatttccagcagcgtcagtgttccgagcgccagccaggcattgggatcggtgatccatgcaaataacatcgtaaaagtcctgccaaaaaaagaagggctaattataagcgcaagcccggtcagggcaaaatttaataaccctgcaacaaaaaatgccgcgccagcaatgcgcgggtaaaattctttttcagataaaagccgcggggcagggtcaggatacgttggccctcggtgcccacggcctcggtcagcgctttactgttcgccgctttcgggcgcagttgtaacacttcgccgtgacgcgcagtaattgtttcaacctgacccagtacgatgagatccattagctcctcccagtccaggcgcaactggcgctcctcatcttcatccggactccacagcagcggtgctcccacacgccgcacggcgagagggatctcccgcgatccttccaccgggatccacagcacacgctttaacttgtgacgcacatgactggtttcccacaccaccccgctattacccgtcaaaggggcaacgcacacaaaggtggtttccagcgggcgtccggcgttatccacaggaatggttttaagctccacaccgagcgccgcgaaatcctgttccggcttgctgcctgcgcttgcgcccagccagcgttccagcaggatcccggtccagcccttatcacgtttcagatcctggggcactggcagaccggccatttgacccagttctcctaacgtgaagcccgccagacgctgtgcctgcgccaacagctttgcttcggtatccggtggtgtagttaagggaacaggtgggaacatgattcagacctttggttaaaaaatgaacaacaattatgcaccggggtgagcagtgaggtttatttctgtgagcaaccttcaatactatgatttaacgactttttttggaaataatcacttatgttgcgcaacagcctgcccggttttccaattctggtcactggcaatgaacaggatcttacaccatgttatccacagaaaagtgggataactggtaaaaaccttcactactgtttccatttacagccttgacgtgggagcaaaatcgaattttcgcacaaattgtgtttaacttggtggcacaaactgtggataaaaccgacgctgtgcgatctttcatcagcgaggcgatcatccctgtgatgatcgtcacataaccgccttttcgttccggtataagtgcattaagctactgacgcatagcgctttattttttcatggcattaatgcggatttaggactactccgggttttccccctttaattccatacttcttcacaactatatccacagaaaaagtgaataaagtggccgcccggaaccctaatctgtttataactcggcagataactgtgagttattcaattgttattaggttatgcaccgttaacagagtggtttaccgtttaccactagtgtgaaacaatcgttcaaattcagattttttttgaggtagtccggtgattgatgacgatggctaccgccccaatgttgggatcgtaatttgtaaccgacagggccaggtgatgtgggccaggcgctttggtcagcactcatggcagtttcctcaggggggaattaaccccggagaatccccggagcaggctatgtaccgggagctgttcgaagaggttgggttaagtcgtaaagatgtgcgtatccttgcttctactcgcaactggttgcgttacaagttaccgaaacgtttggtgcgttgggacacaaagccggtgtgtatcggccagaaacaaaaatggtttcttctgcaattagtcagcagtgatgctgatattaatatgcaaaccagcagtacccccgagtttgatggctggcgctgggtgagttactggtatcccgttcgtcaggttgtctcctttaaacgcgatgtctatcgtcgggtgatgaaagagtttgcaagcgtagtgatggcgctttctgaagcgacgccgaagccgcaaagtcccccagcctggcgacgtaaaagaggttaagccatacataacatgctcacccggctgcgagaaatcgtcgagaaagtggcaagtgctccgcgcctcaacgaggcgctggacgtactggttactgaaatttgtcaggcgatggataccgaggtctgctcggtttatctcgccgatcacgacagacgctgctattacctgatggcgacgcgcggtttgaaaaagccgcgtggtcgtactgtcacgcttgccttcgatcagggcattgtcggcctggtcggtcggcttgcggagcccatcaacctggccgatgcgcaaaagcaccccagctttaaattcattcccgcagtcaaagaagagcgcttccgcgcctttctcggcgtgcccattattcagcgccgccagttgctgggcgtgctggtggtgcagcagcgtgaattacgccagtttgacgaaagcgaagagtccttcctggtcacgctggccacgcagatggccgccattctttcccagtcacagctggcggcgctctttggtcagtaccgtcagacacgcatccgcgcgctgcctgcctcgccgggcgtagccatcgccgaaggctggatggatgccacgctgccgctgatggagcaggtgtatgaagcctcgacgctcgacacctcgctggagcgcgaaaggctcaccggggcgctggaagaggcggccagtgaatttcgccgttacagcaagcgcttctctgccggggcgcagaaagagacggcagcgatcttcgatctctattcgcatctgctctctgacgcccgcctgcgccgggaactctttgaggaagtggaccggggctttgtcgccgaatgggcggtaaaaaaggttattgagcgctttgccgaacagtttgcggcgctgaccgatggctatctgaaagagcgcgccggggatttgcgcatgctcggccagcgtctgctcttccaccttgacgatacattacagggcccgaatgcctggcctgcgcgctttgtgctggtggctgatgaactctccgccaccacgcttgccgaactgccgcacgaccgactggtgggcgtggtggtgcgcgatggcgcggcgaactcccatgcggcgatcatggttcgcgcccttggcatcccgaccgtgatgggcgcagacattcagccgtcgatcctgcatcaacgcacgctgatcgtcgatggctatcgcggtgaactgctggtggatccagagccgatcctgatgcaggaatatcagcggcttatcagcgaagaaaatgaattaagccgtctggctgaagatgacgttaatctgcccgcccagctcagaagcggcgagcgggtgaaagtgatgctcaacgcgggcttaagcccggcgcacgaagaaaatctcgacagccgcattgacggcatcggtctttaccgcaccgaaatcccctttatgctgcaaagcggtttcccctcggaagaggagcaggtggcgcagtaccagggcatgatgcagatgtttatcgacaagcccgtcacgctgcgtacgctggatgtcggcgccgataaacagctgccttacatgccgatcagcgaagagaatccgtgcctcggctggcgcgggatccgcattacgctcgatcagccggagatctttttgatccaggtgcgcgccatgctgcgcgccaacgccgccaccggcaacctgaatattctgctgccgatggtcaccagcatcgatgagatcgacgaggcgcgacgtctgattgagcgcgccgggcgcgaagtggaagagatgatcggctacgccattcccaaaccgcgcattggcgtgatgctggaagtgccgtcgatggtctttatgatcgcccatctggttaaacgggtcgattttatctccgtcggcaccaacgatttgacccagtacattctggcggtggatcgcaacaatacccgcgtggcaaatatgtacgacagcctgcatcctgccgtgctgcgcgcgctggcgatgatcgccgacgaagccgaacggcacgacatcgatctgcggctgtgcggtgaaatggcaggggatccgatgtgcgtcgccattctcatcggccttggctaccgtcatctgtcgatgaacggccgctcggtggcgcgtattaaatatttgctgcgccatatcgatcacgaagatgcgcagacgcttgccagacgggcgcttgacgcccagctggccgccgaagttcgccatcaggtcgcggcctttatggaacggcgcagcatgggcgggttaattcgcggcggacgctaggtgcaggatccggcgaacgttatacatatcttttacaacttcagcgcaatcagcatgtccgccttatgctatgattcgcaactttggcgcgcctgtcgacgcgggcgcacgtctttgccgctgaccactttcggcggaataacaacaagttgtggtgacagatgaacagtggttatctgcgttttccggacatcgatccggtgattttctccatagggccgcttgccctgcactggtacggcatgatgtatctggtcggcttcatctttgcgatgtggctggcgacgcgccgcgctaatcgtcccggcagcggctggacgaaaaacgaagtcgaaaacctgctttacgcaggattcctcggcgtgttccttggcgggcgtatcggctacgtgctgttctataacttcccggtattcatgagcgatccgctgtacctgttccgcgtctgggacggcggcatgtcgttccacggcggtctgatcggcgttattctggtaatggtcatttttgcccgtcgcaccaaacgtcatttcttccaggttgcggatttcatcgcgccgctgatcccgttcgggctgggcgcaggccgtctgggtaactttatcaacggtgaactctggggccgtgtcgatccgggcttcccgttcgccatgctgttccccgcctcccgcagcgaagatatggcgctgctgccggcgcacccggaatggcagtctatttttgatacttacggcgtcctgccgcgacatccgtcccagctctatgaactggtgctggaaggcattgtactgttcatcattctcaacctgtttattcgcaaaccgcgcccgatgggtgccgtctccggattgttcctgattggttatggcgcgttccgcatcattgttgaattcttccgccagccggatgcgcagtttaccggcgaatgggtgcagtacatcagcatggggcaaattctctctatcccgatgattgtcgccggcgttctgatgatgatctgggcgtaccgccgtcgcccgcagctacacgtttcctgaggaaccatgaaacagtatttagacctgatgcaaaaggtgctcgatgagggcacccaaaaaaacgatcgtaccggtaccggcacgctgtctatttttggccatcagatgcgctttaacctgcgcgacggcttcccgctggtgaccaccaaacgttgtcatctgcgatcgattatccatgagctgttgtggttcctgcagggtgatactaacgttgcctatcttcatgaaaacaacgtctccatctgggatgaatgggccgatgagcagggcgatttgggtccggtatacggcaaacagtggcgcgcctggccgacgccggatggccgccatatcgatcagatctccaacgtgcttgagcagttaaaaaacgatccggattcgcgccgtattatcgtttctgcctggaacgtgggcgagctggacaaaatggcgctggcgccatgccatgcgtttttccagttctacgtggctgacggcaaactctcctgccagctttatcagcgctcctgcgatgtcttcctcggcctgccgttcaacatcgccagctatgcgctgctggtgcatatggtggcgcagcagtgcgatctggaagtgggcgacttcgtctggaccggcggcgatacgcacctgtacagcaaccatatggagcagacgcacctgcagctgagccgtgagccgcgcgcgctgcctaagctgattatcaagcgtaagcccgcttcgctgtttgactaccgcttcgaggattttgaaatcgaaggctacgatccgcatcccgccatcaaagcgcctgtcgctatctgatgcgcaaagcgtgacataaccggtgccttagcgcgccggttttttttatccgccgttccattttccggggcgtcttccggaaaaaatgcaaaggcctgcaacggcatttaaacctctcgtaacgccccgcaaaaccacgctttcccgttcgctctctctgcacgtcttcggcacactgccgccatgaaaaaacaacaaggcttcaccctgatcgaaatcctggtcgccgtggcgctggtcatcattctgagcggcgcagggctgtacggctggcagagtttccgcctgcaccagcagctgtggcaaaccgcctggcaggtgcgtgtttacctggagctgctgcgcgatgatgccaactggcagaaccgcgaccaccttatcagcgccagcacaacggaggacggctggtgcctgttaagttcggtgaatgagcgggcaggctgcgcggctgataatgcgtttgcgctgcggccgttgtccgcgggtgtggcgctggctgatatcacgccgtcgctgcgtttttttggtctgcgtaataccgcctggcccgggcatatcgtgctgcgcaatccggcgggcgaatggcgaattatcgtttcaaacggaggacgaataagaatgtgtcaacctgtggcggccacgccatgcatctgacccatcgcggctttaccctgccggaggtgttgatcgcgatgacaatcggcagcgtgctactgcttggcgcggcccgctttctgccggccttacagagggcgatgctcgcccagacccgccagcaggcgctggaagatgaaatctggcagcggctatataccatggcaaaacacgtgcagcgggccggttattgccgtggcctgtgcagcggccaaccgctggtgataaacccgcaggcgtcctgcatcattgtgcagtgggacggcaacagcaacggcgtgtgggatcgcgcgcctgcaaaagagccggatcagaccggatttcgcctgcacgacggcgcgctggaaacccggcgcggggcgacatcctgtcaggataagggctgggataaaatgaccgagcctgagacgatcaccgtagagcagttcagcgtgacgcacgtgcggcctgaaggttttcacagccagctcacgcttacccttgcggccagcgtgaccggccatccggacgagcgcatcaccgcccgccacagcgtaacgggttacaacctgtgaagcgccagcatgggatgtcgtcgctggggctggtactgctcatcatgctgctgggaagtgtgatgctgaacggactaaaccagcgccagcacacgcatcatctgcgggtggtcagcgaaagccgggcgctgcgcacgatggcggatgcgcagtccgccatggagtggggaagggtacagccatggcaatcccggcctgcggtgcagtgtcggcaggcgcacgaccatgactggcgcgcctgtctgcgaatttttgacgaccagacgctgctgctgatcgccgcgagcggcagccatacgctgtggcgtctgggcgcgctggaaaacgatctcgtgatattttcccgtcatggctggagtgatttttgcccgttcaccggggaggcgttatgtcagcttccctgaaaaatcaggcgggattcagcctgcctgaagtgctgctggcgatggtactcctggtgatgatcatcaccgcgctggcgggaacgcagcgtgcaataatgagcggttttatgcacgatagcctctaccgggaggtatggcgtaatgcctggcagcatatacagtggtatcctgttgctccgccagcaggctggcaggtgaagcgaatgcagacaagcacggcgggatgtgtcagcatcagcgtaacaatcacctctcccgtgggtcggcagggtcagatgtcgcggctatattgcccaatcagtcagtagtcaggagcatgtatgttaagggtttatcactccaatcgtctggatgtgcttgaagcactgatggagtttattgttgagcgcgaacgcctcgacgatccctttgaagctgaaatggtgctggtgcaaagcaccggcatggcgcaatggctccagatgacgctgtcgcaaaaattcggtattgccgccaatatcgacttcccgctgcccgcgagttttatctgggatatgtttgtgcgtgtgctgccggacatccctaaagagagcgcgtttaataagcagagtatgagctggaagctaatggccctgctgcccgacatgctggagcaggaggccttcgccatgctcgggaattatctgcacgacgatgacgacaagcgcaaactcttccagctcgcctcgcgcattgcggatctctacgatcagtatctggtgtaccgcccggaatggctgacccgctgggaagccggcgaatgggtggatggcttaggcgaagcgcagatctggcaggcgccgctgtggcgcatgctggttgagcataccgcggcgctcggacagccgcactggcaccgtgccaatctctatcagcggtttatccagacgctggagaacgccagtgaatgtccgccggggctgccgtcccgcgtctttatctgcggcatctccgcgctgccgccggtctatttacaggccttacaggcgctgggtaagcacgtagatgtgcacctgctgttcaccaacccgtgccgttactactggggcgatattaaagatccggcgtttctggcgaaactcatcacccgccgccgcaaacatcatcgcgaagcgcaggaaacgccgctgttccaggaagggctggaggtggaaagcctgtttaatgatgaaggcgagcaggacgtgggtaacccgctgctggcctcctggggtaagctgggacgcgactatatctatctgctggcgggactggatcgctatgacgaactggacgcctttgtggacgtcacccctggcacgctgctcaataatttgcagtcggacattctggagctgaagaacagcgtggtcgctggcgtcaccgccgaggagtatgcgcgcagcgatgcgaaacgcctgctcgatcccgccgatcgcagcgtcacggtgcacgtctgccacagtccgcagcgggaagtggaagtgttgcacgaccgtctgctggccatgatgcaggacgatccggaactgacgccgcgtgacatcatcgtgatggtgtcggatatcgacagctacagcccctttattcaggcggtcttcggcagcgccaccggggcgcgttttgtaccctatgccatttccgaccgccgggcagggcaggcgcatccggcgttacaggcgtttctcagcctgctgtcgctgccggacagccgtttccagtcagaagacgtgctggcactgcttgacgtgcctgtacttgccgcgcgtttcgatattgatgaagaagggctgcgttatctgcgtcagtgggtcaacgaatccggcgtacgctggggcatggatgacgataacgtgcgcgagctggaactgccgcctaccggtcagcatacctggcagtttggcctgatgcgtatgctgctgggctatgcgatggagagtcgccacggggagtggcgctcggtgctgccttatgatgaatccagcgggcttatcgccgaactggtggggcatctggcttcgctactgatgaagctcaatctgtggcgcaaaggcctgtcccaggcacgtccgctggtcgagtggctgccggtatgccgggatatgcttaatgactttttcctgcccgatgccgacaccgaagcggcgctggcgctgattgaacagcagtggcaggcgatgatcgcccacggcgtaggagctgcatataacgagtcggtaccgctgacgctgctgcgggacgaactgacgcagcgcctgaaccaggagcgtatcagccagcgttttctggccgggccggtaaatatttgtaccctgatgccaatgcgctctattccctttaaagtggtctgcctgctgggcatgaacgacggcgtatacccgcgcacgctggcgccgctgggatttgacctgatgagccagaagccaatgcgcggcgaccgcagccgccgtgacgatgaccgttacctcttccttgaggcgctgatttccgcccagcaaaaactctatatcagctacatcggacgctcgattcaggataacagcgaacgctttccgtccgtactggtgcaggaactggtggattacatcgctcagagccactatctgccgggggatgaatcgctcacctgcgatgacagcgcagcaagggtgatccagcatctgaatcacctgcacacccgtatgccattcgatgcggaaaactttgtcagcgatgaagtacagagcttcgcccatgagtggctgcccgccgccagccagcagggcgttgcccacgaaacctttattcagccgctgcccgcgcagcctatagagacgctggcgtttgagcagttacagcgcttctggacgcacccggtgcgggcatttttccagatgcgcttacaggtgaacttccgcccggaagccagcgacatccccgacgccgaaccctttattctggacggtctgaaccgctatcagcttaatcagacgctattgaatacgctggtggaacaggaagacgccgaaaagctgttccgccgctatcgtgccgcaggagaactcccctacggggcattcggcgaaattgtctgggaaacgcagcagcaggagatgcaggcgctggcggatcgcattaacgaatgccgcctgccttgtgaaagcatggagatcgaccttcactgcggcggtgtgcagctcaccggctggctacagcaggtgcaggccgacgggctgctgcgctggcgaccctccctgctcagcgtatcccagggactgcaactttggctggaacaccttgtctactgtgcgagcggcggcaccggggaaagccgtctgttcgtgcgcaaagacggcgaatggcgtttcccgccgcttgaagcagatcaggcgcatcactaccttgaacagcttatcgccgggtatcgcgaggggatgtcgcagcccttacttttactaccagaaagcggcggggcatggataaaagcctgttacgacgcgcaaaatgatgccatgttaaaggacgacgcgacgctggcgaaagcgcgcgcgaagtttcttcaggcttacgaaggcaacatggtggtgagcggcgaaggggacgatgtgtggtatcagcgtctgtggcgcacccttgaaccggaacactttgatgccatcaccgcccaggcggagcgctatttattgccgctctatcgtttcagtcagtcctgataaaaatgagtcgctggcggggccagtacagcgtttgttaatgatgaggtttgtgaatgccgagcagcacctggtttaaagcattaatcatttttgccgccctctgggcaccgttaagtcaggcagacaccggctggcaacccgttcaggaaaccattcgtaaaagcgataaagatacccgtcagtatcaggcgatccgccttgataatggcatggtcgtgctgctggtctcggatccgcaggcagtcaaatccctctccgcgctggtggtgccggtgggatccttacaggatcccgatactcatccaggccttgcgcactatcttgaacatatgacgctgatggggtcgaaaaaatacccgcagccggacagcctcgccgagtttttgaagtcgcacggcggcagccataacgccagtaccgcgccttaccgcaccgcttattatctggaagtggaaaataacgcgctggaaggagccgtcgatcgcctggcggacgccatcgccgcgccgctgttagacaaaaagtatgccgaacgtgaacgcaatgcggtgaatgccgagctgaccatggcccgcgcccgcgacggtatgcgcatggcgcaggtcagcgccgaaaccatcaacccggcccaccccggcgcgcgtttttcgggcggcaatcttgagacgctgagcgataaacccggcagcccggtgcatgacgctctgctggctttccgcgataaatactactccgctaacctgatgaaggccgtggtgtacagcaaccgtccgctgcctgagctggcgaaaatcgccgcgcaaacctatggacgcgtaccgaacaaaaatatcaccccgccggaagtgacggtgccggtggtgacggatgcgcaaaagggcctgattattcactatgtgcccgccatcccgcgtaaagtgctgcgcgtggaattccgtatcgacaacaacacgccgcagtttcgcagtaaaaccgatgagctggtgacctatctcatcggcaaccgcagcccgggaaccctctctgactggcttcaacagcaggggctggtggaagggatccgcgccgactccgatccggtggtcaatggcaacagcggcgtgctggcgatttccgccacgctgaccgacaaaggccttgcccatcgcgatgaagtggtggcggcaatttttagctatctgaaattgctgcgcgaacagggcgtggataaacgttattttgatgaactggcgcacgtgctggatctcgatttccgctatccgtccatcacccgtgatatgagctatgtcgaatggctggcggataccatgatccgcgtgccggtggaacataccctggatgcggtgaatattgccgaccagtacgatccccgggcgctgaaagaccgccttgacatgatgacgccgcagaatgcccgcgtctggtatatcagcccggatgagccgcataacaaaaccgcctattttgtgaatgcgccttatcaggtggataaaatcagcgcgcagacctttagcgactggcagcaaaaatccgccgccatcccgcttaaattgccggagctgaacccctatatcccggacgatttcaccctgctgaaaccgggtaaaacctttgaacatccggagcttatcgtggatgagccagcgctacgggtggtgtacatgccgagccgctatttcccgcaggaacccaaagctgatgtcagcgtggtgctgcgtaatccacaggcgatggacagcgccagaaaccaggtgctgtttgccctgaacgattatctggcaggtatcgcgctggatcagctcagcaatcaggcggcagtgggcggcatcagcttttcgactaacgccaataacggcttaatgcttaacgccaatggttatacccagcggctgccgcagctgtttgaggcgttgctgaaaggctacttcagctatgagccaaccgaagaacagctggcgcaggccaaatcctggtatgcgcagatgatggattcagccgacaaaggcaaagcctacgatcaggctattttgcctccgcaaatgctctctcaggtgccctatttccagcgggaagtgcgccgcgaactgctgccctctattagtctgcaggacgtggtggcctaccgtaacgcgctgaaaaccaacgcccgtccggaatttctggtggtcggcaacatggcggaaagcgaggcgaaagccttagcgcacaacgtacagacgcaactggggacgcagggtaatgaatggtgtcgtaaccgggatgtgctggtagataaaaagcagtcggtcatctttgaaaaagcgggcagcagcactgattccgcgctggctgcggtgttcgtgccgccgggttacgatgagttcagtagctccgcctacagcgccatgctcggccaaatcattcagccgtggttttataatcagctgcgcaccgaggagcagctcggctatgcggtttttgctttcccgttcagcgtcggacggcagtggggcatgggcttcctgttacaaagcagcgatcgccagccagcgtatctgtgggcgcgttataaagccttcttcccgacggcggaagcccgactgcgggcgatgaagccggaagaatttgcccagatccagcagggggtgatcgcgcaaatggagcaggcccctcagacgttaggtgaagaagcctcgcaaatcagcaaagatttcgatcgcggtaatatgcgcttcgattcacgtgataaagtagtggcccagattaaactgctgacgccgcaaaagctggcggatttcttccaccaggcggtggttgaaccgcacggtatggcgatcctctcccaggtttccggcagccagaacggcaaggctgagtatgtgcgtcctgacggctggaaagtatgggataacgtcagcaagttgcagcaaactatgcccctgttaagtgagaaagaatgaccgaacccgcccagacccttgatccactgcgcttgccgctgacaggcgagcgcctgattgaagcgtcggcggggacgggaaaaaccttcaccattgccgcgctctatttgcggctactgttgggccttggcggtccggcggcattcccgcgcctgctgagcgtggaagagttgctggtggtgaccttcaccgaggcggcgacggaagagctgcgcggacgtatccgcagcaatatccatgaactgcgcatcgcctgcctgcgcggttcttctgataatccgctgtatgccagcctgctggacgaaatccccgaccggcaacaggccgccagctggctgctgcttgccgaacggcaaatggacgaggcggccgtgtttaccattcacggcttctgccagcgtatgctgagccttaacgcctttgagtccggcatgctgtttgagcaacagctgattgaagacgaatccctgctgcgcgcgcaggcgtgcgcagacttctggcgtcgccactgttatccgctgccgcgtgatatcgcccaggtgatccacgcctcctggcagggaccgctggatctgctgaaatccatcaaccgctatttgcagggtgaagcgccggtgatcaaatcgccgccgccggaaaacgaaaccctggcggagcggcatcagcagatcatcacgcaaattaacgacatgaaagcccagtggctgacggcctgcaatgaaattgacgcagtgatcgagccatccggcatcgaccggcgtaagttcaaccgtggcaaccagggtaagtggatcgagaagatcaccgcctgggcgcaggaagaaacgcgcagctacctgctgcccgacgcgctggaaaagttctcgcaatccttcctggcgtcacgcaccaaaacggatggcgtggtgccggagcatccgctgtttgtcgcaattgaaacctttctggcccgtccgctgacgttaagcgatctggtgctggtcaaggcgatgaaagaaatccgcgaagccgtggcgcgggaaaaacgccgtcgcggcgcgctgggttttgacgacatgctcagccgtctcgacagcgccctgcaaagtgaaaacggcgacgcgctggccgcggcgatccgccagcgttttccggtggcgatgatcgacgaattccaggataccgatccgcagcagtatcgtattttccgccgtatctggcgacaacagcccgataccgcgctgctgttaattggcgatccgaaacaggcgatctacgcgttccgcggcgcggacatttttacctacatgaaagcgcgtagcgaagtcagcgcccactacacgctggataccaactggcgctcggcgccgggcatggtggccagcgttaatacgctgttcagccgcatggataacgcttttatgtttcgcgagatccccttcctgccggtgaaatccgcgccgaaaaacagcgcgttacgctttgagtttaacggtcagatgcagcctgccatgagcctgtggctgatggacggcgacggcgtcagcgtcggggattatcagacctttatggcgcagcactgcgccgcgcaaatccgcgactggctgattgccggacagcagggcagcgccgtgctgcacgatggcaaagtcagccgcgcggtgaaagcctcggatatcaccgtgctggtgcgcagccgccacgaagcggcgctgatccgtgatgcgctgacgctgctggccatcccgtccgtttatctctccaaccgcgacagcgtatttgaaacccctgaagcgcaggagctgctctggctgttacaggcggtgctggccccggagcgggaaagcacgctgcgcagcgccctggccacctccatgctgggtctgaacgcccagcacatcgaagcgcttaatcttgatgagcaggcgtgggatgaggtggtagaggaatttgatggttatcgtcagctgtggcaaaagcgcggcgtgatgccgatgctgcgcgcgctgatgaagcaccgcaatattgcggaaaatctgctggcgacctccggcggcgaacgtcggctgacggatattctgcacatcagcgaactgctacaggaagcaggcgcgcatgccgagagcgaacatgcgctggtgcgctggctggcgcagcatatcgccgagccggacagtaacgcctccagccagcaactgcggctggaaagcgacaaacatctggtgaaaatcgtcaccattcacaaatccaaaggtctggaatatccgctggtctggctgccctttatcgccaactaccgcgcgcaggaccaggctttctatcacgatcgcacgtcctttgaggcggtgcttgacctgagtgatgccgaggagagcgtggcgctcgccgaagctgaacgtctggcggaagatttacgtctgctgtacgtggcgctgacgcgttcagtgtggcattgcagcctgggaattgcgccgctgtttcgccgacgcggtgagaaagccggcgacagcgattttcatcacagcgcatgcggacgcctgatccagcagggcgagccgcgcgacgccgccgggctgcgggcctgcctgcaaagcctggagagtgacaacatcgcgctgcacattcccggcgtgccggataaccgccgctggcagttcaacagcgaggtgccgccgttgctgcgcgcgcgcgacattgagcgcctggtgcgcgatgactggcgcgtcaccagctattccggcctgcaacagcgtggacacagcatggcgcaggatctgctgccgcgcttcgatctcgatgccgcaggcgaacgcgatgcgcaggaaaccccggcgctgacgccgcaccagtttccgcgcggcgcgtcgcccggtaccttcctgcacagcctgtttgaagatctcgatttcactcagccggtcgcgcctgaatgggtggcggaaaagcttgagctgggcgggtttgacgagcactggcagccggtactgagcgagtggatcaacgcgatcctacaggtgccgctcagcgggccaggcatttcgttaagccagctgccagcccgcgaaaagcaggtggagatggagttttatttgccgatcagcgctaccctgaccgcaccggcgcttgatgcgctgatccgccgttacgatccgctgtccgccgactgcccgccgctcgatttccgcgatgtacgcggcatgctgaaaggctttatcgaccttgttttccgtcataacgggcgctattacctgctcgattacaaatcgaactggctcggggaaagtagcgaagcctatacccaggcggcgatggcgcaggccatgcaggcgcaccgttatgatctgcaataccagctctacaccctggcgctgcaccgttatttacgacaccgcatcgccggatatgattacgagcagcacttcggcggcgtgatttatctgttcctgcgcggcgtggatcgcgacgcgccaggccaggggatttttgccacccgcccggatgtgcaactgattagccagatggacgcgctgttcgccggtgagatgcaggagaacagagaatgaatatgcagaatttattattagaggccgtggcgcaaaaagcgctgcgtccgctggatgtgcagtttgcgctgaccgtcgcccgtgacgatgaacccgccgtgatgctggtggcggcgttgttaagccgcgatgcgggggaggggcacgtctgcctgccgctgtcgcgcctgtccgtcgccgagttcaatcgcctgtatccgcagctgttgcccttgctggaagaagcgggcgtaccggatgactggcgcgcaatgctgcttgcttcgcctgcggtgagcgcaggagatgagccgacgcccatggtgctgaccggtgagcggttgtatctcaaccggatgtggtgcaatgagctgacggtggcgcgctttttctgcgaggccaaccagccgctgccggtgaatgaagatgaaattaaacgctcgctggacgatctctttccggcaaccgacggcatcaactggcagaaaatcgccgccgctgtggcgctgacaagacggatctcggtgatctccggcgggcctggcacgggtaaaaccaccaccgtcgctaagctgctggcggcgctggtgcagaccgccaacggcgacaaatgccgtatccggctggcggcgcctaccggcaaagccgccgcgcgactgaccgaatcgctcggcgcggcgctgcgccagctgccgttaagcgatgagcaaaagaaacgtctgccggatgaggccagtacgctgcaccgcttgctgggggcgcagccgggcagtcagcgcctgcgctaccatgcgggcaacccgctgcatctggacgtgctggtggtggatgaagcctccatgatcgacctgccgatgatgtcgcggcttatcgacgcgctgccgccgcacggacgggtgattttccttggcgatcgcgatcagctggcgtcggtggaagccggtgcggtgctgggagatatctgcgcctgggtgaacgccggttacagtccgcagcgtgctgaagagctgtcgcgtctcacaggcatgcaggtgccctgcggcgaacaacagggcgcagaggcgctgcgtgacagcctctgcctgctgcaaaccagttaccgcttcggcagcgattccggtatcggccagctggcggccgcggtaaaccggggcgataagcccgccatgcgcgccgtcttcagccagggctttaccgacatcggcaaaagcaccttacagaccggcgatgattatcagaccatgatcgatgacgcgctggcaggttatgcgcgttatttacaactggtacgcgacggcgcgccgccagaagacgtgctggcggcgttcagcgagtttcagttgctgtgcgcgctgcgcgacgggccctttggcgtcggcggtttaaacgagcgccttgagcaacgactggcgcagaaacgctggctggtgcgtcatgcccactcccgctggtacgaagggcgtccggtgatgattgcccgcaacgacagcgcgctggggctgtacaacggggatatcggcgtggcgctggatcgcgggcaggggacgcgcgtctggttcccgctgccggacggcaccatcaagtctgtgcagccgagccgtttaccggatcacgataccgcctgggcgatgacggtacataaatcccaggggtcggagtttgaccatgcggcgctgattttgccggggcagattgtgccggtggtgacccgcgagctggtgtataccgccatcacccgtgcgcggcgcaggctgtcgctgtatgccgatgaccgtattctggcgcaggcgattgccacccgcaccgagcggcgcagcggattaagcgacatcttttcactgtgaaagcacccccgcccgctgcgggggcgtaaatcagccgagatccgccatcagcacttttgaacggcgctgatagttgtacatctcttttttgctctccggcagggaatcaatatccaccggcgtaaagccgcgctcctggaaccagtgaatgctgcgcgtggttaacacgaagagtttgctgagtcccatctgccgcgcctgtaaagccacacgctccagcaatacctcaccgcgggacgagctgcggtagtccgggtgcaccgccacgcaggccatttcaccgattttttcttccgggaacggatagagcgccgcgcaggcgatggtcaggttatcgcgctggataatagtgaatttgtcgatctccatctccagttgctcacgcgagcggcgaaccagaataccctgctgctccagcgggcggatcagctccagaataccgccgatgtcgttgatggtcgcacgacggatctgctcggcgctctccattacgatttgcgtgccgataccgtcgcgggagaacagctcctgcaacagcgcgccatcttcctgatagctgatcaggtgactgcgacgcacaccgctgcggcaggctttgaccgccccgcgcagaaagcgcaccgtgcccgactggtaatcctgacgcgcctccagctcctcaacacgcgcctgggcatcgttggggaacagctctgagacgatattgccatcgtcgttgatcaccccctgcgaggagcagaagccgatcattttctccgccttcagcttaatcgccagctgggtggcgatctcttctgacgtcaggttgaagctttcacccgttaccgataccgccaccggccccatcagcacaatggcgccgctgtccagctggcggtgaatggcttcctcgtcgatacgacggatacggccgctgtggcagtagtccacgccatcatccacgcccagcggctgagagataataaagttgccgctcaccacgttgatatgcgcgccctgaagcggcgtgttgttgaggctcatcgacagccgggcggtaatatccagctgcaactgacctgccgcctgtttaaccagctccagcgttttggcgtcggtcacgcgggtatgtttgtgataaaccggctcgtgatgatgcgcggcaaggttcgcgtcaatttgcgggcgtgcgccatacaccaccaccaggcgaatgccgaggctgtgcagcaagccaatgtcattgacgatactggaaaagttctcatgctcaatggcttcgccgcccagcatgatgacaaaggttttcccccgatgggcattaatatagggaactgaatggcggaatccctcgaccagttcggttctacgctccttcaccacggcacaaccctcactgcatgattattcggattttgtgtatttttattcttttatggcggcgggcgcaagcctaaatttgccgcggctccattttcattgccacgagaattaagttacgaatgctatgtttacccttttgttgatgacagtttatgcgtcattcgttaaagttttcggtcaatttggacgtatagatagcttattagatttactttgctcgggagaggcatgtcaggatccaattcaattatcagccgccgccgtttactgcaaggggcaggcgcgatgtggttgctcagcgtaagccaggtgggactggctgcggtaagccaggttatcgccgtgcgcgtctggcctgcatccacctacacgcgcgtgaccgtggaatcgaaccggttattaaaatatcgccagttcgccctgagtaatcctgaacgtctggttgtggatattgaaggcgtcaacctgaactcggtcctcaaaggcgtgggcatgcagatccgcgatgacgatccctttatcaaatccgcgcgcgtcgggcagttcgacccgaaaaccgtgcgtatggtgtttgaactgaaacagaatgtaacgccgcatctgttctcgctggcaccggtcgcggagtttaaagagcgtctggtgatggatctctatccggtaaacggacagaacgaacaggatccgctgctggcgttgctggaagattacaataaaggtgagttagatcggcaggtgccgcctgcgcagagcggaccgaagccggggaaagcggggcgcgatcggccgattgtgatcatgctcgatccgggacacggtggggaagatcccggcgcgattggcaaatataaaacccgggaaaaagacgtggtgctgcaaatcgcccgtcggctgcgagcgctcatcgatcgtgaagccaatatgaaagcctatatgacccgtaacgaggatgtgtttattccgttgaaggtgcgggtggcgaaagcccagaagcagcgcgcagatctgtttgtctctatccatgcggatgcctttaccagccgggcagcgcggggttcatctgtatttgcgttgtccaccaagggcgcaaccagtaccgcggcaaaatttctcgcccagacgcagaacgccgctgacctggtggggggcgtcagtaaaagcggcgaccgctatctcgatcacacgctgttcgacatggtgcagtcgctgacgattaacgacagcctgaagtttggcaaagaggtgttaaagcgtcttggcggtatcaacaaactgcacaaaaaccgcgtggatcaggcaggcttcgctgtactgaaagcgccggatattccgtcgatcctcgtcgaaacggcgtttatcagtaatatcgaagaagagcgcaagctgaagaccgcgaagttccagcaggaagtggcggagtcgattctggcagggatcaaagcgtactttgcagagggcggggcactggcacggcgcggataacgcgtcgtttttttacggaacgcagaaacaaaaaaacacccgtcagggtgtttaatgtgttggttgcgggggccggatttgaaccgacgaccttcgggttatgagcccgacgagctaccaggctgctccaccccgcgtccgtctttactcttccatcgagtaaactttctctttgtgcataattggttgcgggggccggatttgaaccgacgaccttcgggttatgagcccgacgagctaccaggctgctccaccccgcgtccgtcttttactctttcattcgagtaaacgtcttactgtaatgcacttaattggttgcgggggccggatttgaaccgacgaccttcgggttatgagcccgacgagctaccaggctgctccaccccgcgtccgtggaagcgcactatactccgctcgctctttgacgcaaccctttttccaaaaaaaggcgaatttcattgagcatctgaataaaaatagtgcagccaggctattttttatactcctcggggctgtgatgccgttcgcacatttcattagcgacacgggtttgttatcttcagagcacgcattcggcttaagtaagaagacgagacataatgaaaggacgttgggcgaagtacctactcactggcgcgatggtggtgatcctcgcagcctgttcctccaaaccgaccgatcgcggtcaacaatataaagacgggaaattcacccagcctttctctctggttaatcagccagacgccgtaggcgcgcccattaacggcggcgattatgccgaacaggtcagtcaggtgcgcaccgcgtcaccgcgtttatatggcaaccagagcgccatctataatgccgtgcaggactggctgcgcgcgggtggcgatacgcgcaccctgcgccagtacggtctggacgcctggcagatggaaggcgcggataactacggcaacgtgcagttcaccggttactacacgccggtagtgcaggcgcgtcatacccgtcagggcgaattccagtacccgatttatcgtatgccgccaaaacgcggacggctgccgtcccgggcggagatctacgccggggcactgagcgacaactatatcctcgcctacagcaactcgctgatggacaactttattatggacgtgcagggcagtggctatattgatttcggcgacggcagcccgctcaacttcttcagctacagcggcaaaaacggccatgcctaccgcagcatcggtaaagtgctgatcgatcgcggcgaagtgaagcgggaagatatgtcgatgcaggcgatccgtcactggggcgaaacgcacagcgaggcgcaggtgcgcgaactgctggagcaaaatccgtccttcgtcttcttcaaaccgcaatcttacgcgccggtgaaaggggcgagcggcgtgccgctgattggccgcgcatccgtggcctctgatcgcagcattattccggccgggacaacgctgctggcggaagtgcctttgctggataacaacggcaaattcaacggccagtacgagctgcgtctgatggtggcgctggacgtgggcggcgcaattaaaggccagcacttcgatatttatcaggggattggcgcagacgccggtcatcgcgcgggatggtataaccattatggccgcgtgtgggtactgaagaccgcgccgggcgcaggatcgggtaacgtgtttagcgggtgatcgtgctactattttgcccctctcctgcaaggggaaggtgatcatcaactccatttctgaggttttatgtctgcggtaatcagcgacgcctggcgtcagcgttttggtggcacagcgcgtctgtatggcgaaaacgcgttgcagctttttgcggatgcgcatatctgcgtggtggggatcggcggcgtcggatcctgggcggcggaagcgctggcgcgcaccggcatcggcgctatcacgctgattgatatggatgatgtctgcgtcaccaacaccaaccggcagatccacgccctgcgcgacagcgtgggccttgcgaaatccgaagtgatggctgagcgcattcgtcagatcaacccggaatgccgggtgacggtagtggacgatttcgttaccgccaacaacgtggcgcagtacatgagcgccggattcagctatgtgatcgacgccatcgacagcgtacggcctaaagcggcgctgatcgcttactgccgtcgtaataagatcccgctggtgaccaccggcggcgcgggcgggcagatcgatccgacgcagatccaggtcagcgatctggcgaaaaccattcaggatccgctggcggcgaagctgcgcgaaaggctgaaaagcgatttcggcgtggtgaaaaacagcaagggtaagctcggcgtggactgtgtgttctccaccgaagcgctggtgtatccgcaggcggacggctcggtatgcgcgatgaaaagcaccgcagaagggccaaaacggatggactgcgcctcaggctttggcgcggcgaccatggtcaccgccacttttggttttgtggcggtgtcccatgcgctgaaaaaaatgatggcgaaagcggcgcgtcaggcctgacgcgcggcatcctgtacggcggcggccagcgccgccagcccctgactgcgcgatgcgctgagctgtccgcgtaatcccagctcatcaaacagcgccagcggatcctgcgccagcagggtcggcgcggtttttccctccaccgccgtcagcagtaccgccagcagtccccgcacaatgcggccttcgctgtcgccgaagaaatgcagttttccctcgcctgaaagggtatgtcccagccagacgcgattttcacagccgggaatttcccgcgcctgggctttaagatcgtctgacagagcaggcaactgtttaccgagcaggatcagctgtcggtatttatcttcccactgcgtcagcgggttaaagatctgacgcagtgtgtcttcggttacggcgctgccgaacgggtgtccggcgaaagcagggttagtcattaatccaccagaagttcaagggcgcggtcgatggcgttaaccagcgcatcgacatcgtttttcgtattatagggcgcaaaagaggcgcgcagtgtaccgctgacgccaagcgccgccagcagcggctgggcgcagtgctggcctgcgcgcagcgcgatgccgtactctgccagcagcgtcaccatatcgctgtggtgcaccccggcaaaatcaaaggccagcaggctggagtcctggcaacggaacgagcggaagccggggcgttttgccagcgcgtcttccgccagcgtcgccagcccgcggctgtagctttcggcctgccccatatccatttcttccagccattccagcgccgcgctcagcccaatcaccccggccacgttcggcgtgcccgcctccaggcgccagggcaccggctgggttttaaagccgtcaaaggtgacctcggtgatcatcttaccgccgcccagccagggggacatcacctccagcaattcgcttttgccgtacaacgcgccgatgccggtcgggccatagagtttgtggccggaaaaagcataaaaatcaatgtccagcttttgcacgtccgccgggaagtgcaccgcgccctgtgcgccatccaccatcaccaccatgccggcagcgtgggcgagagttatggcgcgcgccagatccgggcagccgccggtgacgttggacatttgcccgatggccataatgcggctgcggggggtgatcagcgcgggaagttgttcaatgtccggcacaccgtcggccgcaacaggcagcttcaccacgctcgcgccggtttgctccgccaccatcagccagggcaccagattggcatgatgctctgcctcgctgacgataatctcatcgcctggctgtaaacgcggacgcgcataacactgggcgaccatattgatcgcctcggtggtgccccgcgtccagacgatgttgttaccggcaggcgcgttaagcagggcggcaacctggtcgcgcgcggcttcatagcgcgccgtcagtttttgcgcctgcgcatgctggctgcgatgcacgtttcctgcgctcaggctgtaaaactgctgcgtggcgtcaatgacggcctgtggttttagcgcagtggcggcgctgtccagatagacgcccgcatcggcaagagcaggaaattgggcacgaaaatgggcaggattgaatgcgttcatggcgttcctcatagtcagacgatgatcgtcgcgcaatttgcaaactgatacaagcgcctgtgctccatcagatttttctgtttatcctggcgcactttcgaaagcaggttatgctaaatagtgttgggtggacgttgaaccctgttaataaacaagattcagatagcattaattgctaaaaggagaagaatcatgaaaaagactgccgccattattaccgcatgtatgatgacttttgcactgagcgcctgttcgggtccgaactatgtaatgcacaccaacgatggccgttccattgtgtctgaaggtaagccgaaaaccgacgatcaaaccggcatgatctcttataaagacgctaacggtaacaaacagcagatcaatcgcactgacgtaaaagaaatggttgctctggaaaaataatagcccgtttcagagtaaaaaaaagcaccgcaatttgcggtgctacattaatcactatggacagacagggtaaatgtacaggaagtgaaaagggtagcgttgctaccgtggtctgaatagcagaccaattgcaaacacaacatcacaaccgcaagccaaaagcccttcagaacacgcattccaaaaaagactcttcgttccggctcaggaagtgccgccactataggtatttgctggtagttcctcaacggacaaattataatgtctcagataaaaaaaactaatgggttaaaccttgtttcctgtttgttaaattccattaacatctgaaccttataatcatgtccaagcgcttaccacctcttaatgcattacgtgtttttgatgccgccgcacgccatttaagcttcacccgcgccgcagatgagctttttgtgacgcaggccgcagtaagccatcaaatcaagtctcttgaggatttccttgggctgaagctgttccgccgtcgcaaccgttctctgttattaacagaagaaggtcagagttattttcaggatattaaagagattttttcccaactcaccgacgccacccgcaaactgcaatcgcgcagtgctaaaggggcgctgaccgtcagtttattgcccagttttgccattcagtggctggtgccgagactcaccagctttaattcagcttatccgggaatcgacgtcaggatccaggcggttgaccgcgaagtggacaagctggcggatgatgtcgatgtggcaattttttatgggcgcggcaactggccgggcttgcgtgtcgaaaaattatacgcagaatatctgctgccggtctgctcgccgttattgctcactggcgataagcccctgaaaacgcctgcggatctggcaaaacatacgttattgcatgatgcttcccgccgcgactggcaaacttatacgcgacagttaggtcttaatttgaatgtgcagcagggaccgattttcagccatagcgctatggtgctacaggcggcaatccacggacagggtatcgcgctggccaacaatgtgatggcgcagtccgaaattgaggcaggccgactggtctgtccgtttaatgatgtactggtcagtaaaaacgcgttttatctggtttgtcatgacagtcaggcagaactgggtaaaatagccgcctttcgacagtggatcctggcaaaagcggcatcagagcaagaaaaattccgcttccgttacgagcaataattcaacgcgcgcgatttcgcgcatgactttttagggtactgacatgaccagccggtttatgctgatttttgctgccattagtggctttgtttttgttgcgctgggcgccttcggcgcgcacgtgctggggaaatctctgggcacggtagagatgggctggatccagaccggtcttgaataccaggctttccatacgctggcgattttctgcctcgccgtggcgatgcagcgtcgcatcagcatctggttttactggagcagcgtgtttctggcgctgggtacggtgttgttcagcgggagcttatactgcctcgcgctttcccatctgcgcctgtgggccttcgtcaccccggttggcggcgtctgcttcctcgcgggctgggtattaatgttaattggtgctattcgtctgaaacgtaagggcgttgttcatgaataaagttgtcttgttgtgtcgcccgggttttgagaaagagtgcgccgcagaaattaccgataaagccggacgccttgaggtgtttggctttgcccgcgtgaaagaaaactcaggctatgtggttttcgaatgctatcagcctgatgatgcggataaagtggcaaaagatctgccgttcagctcgctgatttttgcccgtcagatgtttgtcgccggtgagctgttacaggatctgccgcctgacgatcgcatcacgccgattgtcggcatgttgcagggcgtggtggaaaaaggcggcgagctgcgcgttgaagtggcggacaccaacgaaagcaaagagctgatgaagttctgccgcaagttcaccgtaccgctgcgtgcggcgctgcgcgaggcgaaaatcctcaccagctacgaaaccgcaaaacgtccggtggtgcatgtgttctttatcgctcccggctgctgctatgccggttattcgtataccaataacaactcgccgttttacatgggcattccgcgcctgaagtttccgtcggacgcgccaagccgttccaccctcaaactggaagaagcctttcatatcttcattccggcagacgagtgggacgagcgcctggcaaacggcatgtacgcggtggatctgggcgcctgtccgggcggctggacctatcagctggtgaaacgcaacatgtgggtggcctctgtggataacggcccgatggcgcagagcctgatggataccgggcaggtcacctggctgcgtgaggatggtttccgctatcgcccgacgcgcaataacattacgtggatggtgtgcgatatggtggagaaacccgcgaaagtcaccgctctgatggtgcagtggctggtcaacggctggtgccgcgaaaccattttcaacctcaagctgccgatgaaaaaacgctacgaagaagtgtccggcaatctggcgtacattcaggagcaactggcggagcacggcatcaatgccactattcaggcccgtcagctgtatcacgatcgcgaagaagtgaccgtacacgtgcgccgctggtgggctgcggtgggcggacgtcgcgacgagcgttaaaactgcaaccctcaccctgaggtaaagtgtggatccctctccctggagagagggtcagggtgaggggattatctcgccagccgcagctgctgcaaattcccttccacctgtagatccgttttcagccttgccacatcccggcagataaacgccatttcgcgatgttccaccagttttttgcgccacttttccggtacctccgcaagccctgcatagagattttccagcgtgccaaaggtggtgataagctgcgtggcgctcttctgcccgatacccgccacgcccggaatttttgaactgctgatccccgcgagtccccagtaatctgccagttgctcaggcgtgacgccaaattcagcggcgataaagggcgcatccagccagcgcttctgaaaatagtcgcggatgcggatggtcggagagagcagctggcagtagcctttgtccgttgacactatggtggcctgatgcccggcctgcgccacttttaccgccagggtggcggccagatcgtccgcctcattgccttctgacacccagcatggcacgccgtggctggcaaaggccgcacgcagggcaggcatttccgcgtgcaggttgtccggcatcggcgcgcgacctgctttgtaatccggcaggatctgatgtcgccagccgctgttgcgcgcctcgtcatcaaagaccgccaccgcatgagtcggctggctgtgaaggatcaactggtcgagcgcgtgcaggcaggtctggacgcagggcgatccctgcacggcatggatccggcgaataagattaagcgcatcaacaattaacagatgaacagccacagcacgctcccgaaaaaatttaacgcgctaagggtaacaccggcggtgaggaggaggccagaaagcgggggaaaaacaggaagacgcctcgcaaaaaagccgggtggcataagcgcacccggcttcataaaggaacgactgacgtgattaatcgcaggcgacgactttcatcgccagaccgccacgggatgtttcgcggtatttggcgttcatgtctttgcccgtctcatacatggtctcaatgactttatcgaggcacacgcgcggctcgctggtacggcgcagggccatacgcgcggcgttcaccgctttcaccgaggcaatggcgttgcgttcaatgcagggtacctgtacctgtccggcgaccggatcgcaggttagccccaggttatgctccatgccgatttcggccgcgatgcacacctgcgtcgggctgccgcccagcaattccgccagacctgccgctgccatggagcaggccacgcccacttcaccctgacagcccacttccgcgccggaaatggaggcgttcattttgtacagggagccgattgcgctggcgaccagcagatagcgggccagtgagttagcatttacttcacgaataaatttatcgtagtacgccagcaccgccggcacgatgccacaggcgccgttggtcggcgcggtcaccacacgtccaccggcggcgttttcttcgttcaccgccagcgcgaacatgttgatccagtcgaccaccgccatcggatcggtagaagttttatcaccgctgaccagcatacggcgtaacgccgccgcccggcgcgggacgcgcagtttgcccggcaggacgccttcggtggtaatgccgcgctcaatgccgccgcgcatcacttcccagacgtttgccagatgctgatccagctcggctttgctgcgcagcgccagctcgtttttcatcatcaggccggagagggataagccggtttcctggcaatgacgctgtaaatcggcggcatttttataggggtacggcaccgtgatttctgcattactggtcaggccgaagtgcgcctcatcgacgataaagccgccgccgatggagtaataagtctggctgtaaaccacgctttcacccgccagtgcgctgatacgcatgccgttttcgtgcagggaaaggttatccgcatggaagttcatgcactggtcaaccggaaattccacttcatgctgaccgttcgccagcagcaggcggccatgggtattcacgtcctgaatgaagcccggaatgctgtcgatgtcgacgctgtccggcaggttgcccgccagccccataataatggcgatatcggtatggtggcctttgccggtgagggagagggagccgtaaacatccaccacgacgcgagtgatgtcactgagaatgccacgcgcaatcaggtcgtccgtaaactgtttacctgctttcattggtcccacggtatgggagctggaagggccaatgccgattttgaaaatatcgaatacgctaatcatgatgcattatccgttgctatgagtcagagggcgccgcccgaaaaggcggcgcggggggattagctgaacagggagtagaagatagcggagatagctaccaggcccatgcagacaacgaagatgttgctgatgtgaccgctgtatttgcgcatcgccggcactttctgaatcgcatacatcggcatcaggaacaggatcatcgcgataatcggaccgcccagggtttcgatcataccgaggatgctcgggttcagggttgccacaatccaggtggtcaccagcataaacagcgcggtgattttattcagacggctgatttcgatggttttgccacggctgcgcagggatttgatcaccataccgttgaagccttcacgcgcacccagatagtggccgaggaaggatttagtgatggcgatgatggcgataatcggtgccatccacgcaataatcggcgcgttaaagtggttagccagataagacagaatagagatgttctgatctttcgcagcctgcaaatctgccggcgtcaggctcagcacgcagctgaacacgaagaacattaccgtcagcaccatcatgatgtgcgcgaacgccaggatgcgggagcatttcttctcggcttcatcaccgtactcttcacgtttcgccacggcgaaggaggagatgatcggtgagtggttgaaagagaacaccattaccggaatagcaagccacagggtcatccacaggcctttaccggtactggctgctgcgtcaaaggagagcgtttccagcgcggcaccgctccactgcgggatcaggtacagggccagcagcatcagcgcaaccacaaacgggaacaccagaatactcatcgctttcacgatcatctgctcgccgaagcgcacgatggtcatcataccgacgatcaggatcagggaaagaatgaaacgcggcggcggcgtcatacccagctggtgggtcataaagctgtcaaccgtgttggtgatcgccacgctgtagaccagcaggatcggatagatagcgaagaaatagagcagggtgatgagtttacctgcgccgataccaaagtgttcttctaccacttcagtaatatcttcccccggattttttccggacagcacaaagcgggtcaggccacggtgagcaaaaaaggtcatcgggaaggcgatgatggccatgatgatcaacgggatcataccgccgacaccggcgttgatcggcaggaagagcacacctgcgccgatagcggtgccgtaaaggcccagcatccacatggtgtcagttttacgccatgcgctgcgcgtttctacggcagcaacagtgctggtttgagttgtttccatctgtatctcctggaggaagctaaatatcaggtttttcagtgcaatctaatgaaaagtggcctgacggtaatatgaaatctgttcagcgacggtttttttataatttcttgccgtaactatcggcgggcggaaagatacatttatgtaatgaatgtatcagtgatcccgatcgcaaatgcaataatccgctttctctggggttaatgacaggtcatcccactgcaaagcgatcccaagccaaaattaatggtggcgcaggctaccactgacaatatatgcacgcaaagcatcaaacgaaaaatacgacaaaatcgctgcaaaagatgatgtaaacagcgttttctgaggaatacctgaggtaagaatggatttttagcggtgaaatagcatacgcaaccgtttggcttagggagcagaaataagactggcttataacgggcaggatggctttgcccggcggcgcaggcttgccgggcctacgaaacggataccggatggcagagagtaggccgggtaagcgcagcgccacccggcaaaacagttcaacggccgggtaagcgtaatgtcacccggcatgagaacccgctatcaggtcataatttcatagcagggaatatacgccgagcccggcagcttcatgcggtgctgcgcgacaaagccctgcagcaggtcgtccatgcggcgcatcatgtcgctgtcgccgtggattttgtacggcccgtatttttcaatcgcgtggatccccgcctctttaacgttcccggcgacaatccctgaaaatgcgcggcgcagatcggcggccagaatttccaccggctgatctggatagagcttcaggttcgccatattttcatgggacgggatgaaaggcacctggagttccggcgcaatgcgaattgaccagttaaagctgtaggcatcgccggtctcacgacgattctctttcaccatcggcatcgcttttttcatcagccgcgccacttcatgggcgtcatcaataatcacgcggtaataacgacgcgcgccttcgcccagcgtgttaacaataaattcgtcgagcacgcggaagtagtcagcgctctgttttggcccggtgaggatcaacggcagcacctggtcctggttggcaggattcatcagaatgcccagcagatagagcagttcttccgccgtaccgacgccgccagggaagatgataatgccgtgggcgatacgcacgaaggcttccagacgcttttcaatgtccggcatgatcaccagctcattgaccagcgggttcggcggttctgcggcgataatcgacggctccgtcatgccgataaaacggccttctttgtaacgctgctgcgcatggccgaccgccgcgcctttcatcggcgcttccatcgcccccggcccgcagccggtgcagatgttcagttcacgcaggccgagttgggtgcccacgcgtcgggcgtacaggtattcggtttcgttgatcgagtgaccgccccagcacaccaccatgttcggcgcttcgccgacgtgcagcgcacgggcgttacgcaggatggaaaacaccaggttggtaatgtgggtcgagctttccagatttaaatgctggaaacgaccggcgctgtggatctgtccgttaacgaacagaatgtcgcgcagtacggcaaacaggttggcctgaagcgcgcggatgatacggccatccacaaaggcgtcttccgggggattgatcagttcaagcttgacgccgcgctcacgacgcaaaacgttaatgtcgaaactttcaaaacgcgacagcagctctttgctgttatcggtcagactccctgagttaagaactgccagtgaacagttgcgaaacagctggtacaggtcgctgctggccgtgcgtttaagcatatcgacttccagctgcgacaacatatccattgagcctagcgggctaatatgtgtaatcaagtgagctccttacggggcgaaaatcgccgctccctgtgattacaatagccctggcttatgacgtttaacaacctcatgcgccgattgtgcggcgcaaatgcagaaaattgtctgtttactggcgaaccagtcttccggttgagggcgcaaaatcgccgttggtgcgccacggattaatgtccagaccgccgcgacgggtatagcgcgcatatacgctcagggattctggcttacaaaaacgctgcacatcattgaaaatgcgctccacgcactgttcatgaaattcattgtgatggcggaaggagaccagataacgcagcagcttctcacggtcgatttgcggaccgcgatactggatctgcaccgaaccccagtccggctgatgagtgatcaggcagttagatttcagcagatggctgaccagggtttcttccacaatcgggccgctggcggcgttttccaggtaatcggcgctaaagtcgtagttatcgatcgcaatatcctgatcgtcgatgcacacaccgttgaacgcggcgatcggctgaccttccagttcattaaggcgataaagcgccacgctcacgtcgccctgcgcacaggcgctgagatcgcgctgcagggtggcctgcacctcgtcccagctggcgaaacgcgtctggttgaagctgttgagataaagcttgaagctttttgattccaccagattgacgctggcatagttaagttccacctgtccaaccgccacctgcggcaggccattactgttcagccatgacagctcatagagcgtccagatatcgccgccgtgaaagggcaggttgtcggcatgcaggccgagcggatcgcggttcaggctgcgcggtacgccctgcaacaggctggcgtcgtaggtatcgcggtacgcggtggatttgccgagggtcaggccagccagcgcctggtggttatcataagaagacatgtttcatcgccattttgcaggtaaactatccgccaagtttatcctggctttggttaagagagaaatcggtgcacacagaaacggcgctcgccctgaaagcatttaccgcacgctattgcgatgcctggcatgagacacaccacagctggccgcagagtgaagatttgtacggcgtgccctcgccctgcattatctccaccacccaggacagcgtattctggcagccgcaaccctttgaaggggaacccaatgtaaacgcggttgaacgggcattagatattgtggtacaacccgcgctgcacgcgttttatgccacccagtttgccggtgatatgcccgcgcgctttggcgcgcagacgctgacgctgctgcaaacctggagcgaggacgatttccgccgcgtgcaggaaaatctaattggccatctggtgacgcaaaagcgacttaagatttcgcccacgctgtttatcgccacgctcgacagcgaactggacgttattgccgtctgcaacctgaccggacaggtgattctcgaaaccatcggtacggcgaaacgtacggtgctggccccgtctgttacggaatttcttaatcagcttgagcctgttctgtaatccagattactactgagtttgtgagagatctcttacacaggctgtaggagatcgccaggattttcttctcattcagtccgtcatgctctcccgttaagcccttatattcaacaagttaacctcataaactcccgtctgtgtcgaatgctattctgattatgttcttaagcaccttcttgtaggacagggcaaaaaagcggatccttatccccgttgacaagaggtcacattgcgaagtggatgccgggatggtgtagcttcgcagcaggaacaccaggacggtgctgcaaggaaaggcttccggatgaagcaaagtggatgacgcaggacgcgttaaagtacacctccaggacggagaatgagagccggtcaggatgcccggcggaccaggatgttcagggacgggcgttacggataacgcagatcgtatcggggtggtacgagcaggatgcagttgtttacggatgaacaggtcaggagaccgcaggaaaagttgtcaaggatgagcagggagcaacaaaagtagccggaatgctgcgaaacgaaccgggagcactgtttttacagtgctccctttttttgttcaggcccgactagtgctatcctgcgcgccagttttattttcagtcgaggttgatatgactccccaccagcacgtgcgccaacaactgttcagcctggaaaccctgttaaacgagcagggcatctggcaaacccattccccggtcgccagcgctttcgaaagtaccgagcctttttgtctggataccatggagccgttcgagtggctgcaatgggtgctgatcccgcgtatgcatgccctgttagacagcggacagccgttgccgcagaccttcgccatcgcgccttattatgaagtcgcgcttgatgccagccatccggcccgggatgtggtgctggtacagcttcaacagcttgatgccatctttgctggcgataacgcctgatgctggagatcatctatcaggacgaatggctggtggcggtgaacaaaccttccggctggctggtgcaccgcagttggcttgatcgcgatgaaaaagtggtggtgatgcaaaccgtgcgcgaccagattggtcagcacgtgtttaccgcccatcgcctcgatcgtccgacctccggcgtactgttgatgggcctgtccagcgaggcgggccgcctgttatcgcaacagtttgaacagcatcagatgcagaagcgctatcatgcgatagtacgcggctggctgatggacgaggccgagctggattacccgctgaccgaagagctggataaaatcgccgacaaattcgcccgcgcagataaaggccctcagcccgcggtgacgcactatcgtgggctggccactgccgagatgcccgtcgccaccgggaaatttcccaccacccgttacggactggtggagctgctgccgaaaaccggccgcaagcaccagctacgccgccatctttcgcatctgcgccatccgattataggcgacagcaagcacggcgatttaaagcaaaaccgcagcgccgccgaacacttcggctgtcagcgcctgatgctgcacgccagcgaactgtcgctgacgcatccttttaccggcgaaccgctggtgctgcgtgccgggctggacgaggtctggatgcaggcactgtcgcactttggctggcgggggcttctccctttaaatgaaagggttgagtttgccgcatgcagcggtcaggatgaagagagtcaagtctgaacaaggagtgaatagcatggcagaagtaggcatatttgtcggcaccacctatggcaacgcgctgctggtggcggaagaagcagaagcgatcctgagcggccatggacataaggccaccgtttacgaagatgcagtgctcgccgactggcagcgctaccaggataaaattattctggtgatcacctccaccaccgggcagggggattttcccgacagcatcgccccgttgttccatgcggtgaaagatcagatcggcgtgcagcctgcactgcgctatggcgttatcgccctcggcgacagcacctatacgcacttttgcggcgccggtaaaacctttgatgccctgctacaggaacagaatgcacagcggctgggcgaggtattactcatcgacgccagcgaagatccggagccggaatccgtctctaacccgtgggttgaacactgggctaccttgcttaactaaataaaagccaccctgaaggtggctttttacattcttactcccctttctgttcatttccgtgaagtactccccatagccctgggcttttgcatcaaaccttcaccccacgcctgcgtaatgttgtggggttgcacagtgagtgttcgtagcccgctttttatactttttgagccagatacaaatgcagcgttcaggggaaagcgacctgacagatgaactgcaaaaaataacagcatgatcccgggcaccctaccgctacaccgacgggaaacatgctacgaacatctacgcttcgggagtacaaccatgagttcattaagccacgcggcgagcagtgcggaaaaacgcaccaacgcccgctactggatagtggtgatgctgtttatcgtcacatccttcaactacggtgaccgcgccacgctgtctatcgccggttcggaaatggccaaagacattggccttgatcccatcggtatgggttatgttttctcggcattttcatgggcctatgtgattggccaaatccccggcggctggctgcttgaccgtttcggctccaagcgcgtctatttctggtccatttttatctggtccgccttcaccctcctgcagggtttcgtcgatattttcagcgggttcggcatcatagtcgcgctctttaccctgcgcttcctggtcggactagctgaagcgccatctttccccggcaacagccgtatcgtcgcggcctggttcccggcgcaggagaggggtaccgccgtcgccatttttaactccgcacaatacttcgcgacggtgatcttcgcgccgatcatgggctggttaacccatgaggtgggctggtcgcacgtgttcttctttatgggcgggctggggattatcatcagctttatctggctgaaagtgatccacgaacctaacgaacatccgggcgtaaacaaaaaagagctggaatacatcgccgcaggcggcgggctgatcaatatggatcagaaaggccctaaaacgcatgttccgctcagtcaaaagtgggggcagatcaaacagctgatcggctcccgcatgatgctcggcatctatctcggccagtactgcattaacgccctgacttacttctttatcacctggttcccggtctatctggtgcaggcgcgcggcatgtcgatcctgaaagcaggctttgtcgcctcggtaccggccatctgcggctttgtaggcggcgtgctgggcggcgtaatttccgactggctgatgcgtcgtaccggctcgctgaatatcgcccgtaaaacgcctatcgtgctcggcatgatgttgtcgatggtgatggtgttctgtaactacgttgaaaccgagtggatgatcatcggctttatggcgatggcgttcttcggcaaaggcattggcgcgctgggctgggcagtgatggcggataccgcgccgaaagagatcagcggcctctccggcggactgttcaatatgttcggcaatgtctccggcatcgtcacgccgatcgctatcggctatatcgtcggcaccaccggctcctttaacggcgcgctgatttacgttggtatccatgcgctggtggcggtactgagttatctggtgctggtgggtgacattaaacgtgtcgaactgaaacctgtggcgggacgtgaatgatgaatacacaggcaactcccttaattgccagcatgcgggtgatcccggtagccgggcacgacagcatgctgatgaatatcggtggcgcgcataacgcttacttcacccgcaatatcgtggtgctgaccgataacgccggtaacaccggcgtcggtgaagcaccgggcggcgaaaccatttaccagacgctggtggatgccattccgctggtagtggggcaggaagtggcccgtctgaataaagtcgtacagcgggtccacaaaggcaaccaggccgcggattttgacaccttcggcaaaggcgcatggacgtttgagctgcgcgttaacgcggtggccgcgctggaagcggcgctgctggatctgctgggcaaagcgctgaacgtgccggtgtgcgaactgctcggtcccggcaaacagcgcgatgcggtgaccgtgcttggctatctgttttacgtcggtgaccgcacgcaaacgccgctgccgtaccttgacgcgacgccgggcaatcacgactggtatcgcctgcgtcatcagcacgccatgaccagcgaggcggtggtgacgctggcgcaggcggcgcaggatcgctacggctttaaagacttcaaactcaagggcggcgtactgcccggcgagcaggagatcgaaaccgcacgcgcgctcaagaaaggttttccggatgcgcgtattaccgtggatcccaacggcgcatggctgctcgatgaggccattcgcctgtgtaagggactcaacgatgtgctgacctatgcggaagatccatgcggggcggagcagggcttttccggacgcgaagtgatggcggagttccgccgcgcaaccgggctgccggtcgccaccaatatgatcgccaccaactggcgggaaatgggccacgccgtcatgctcaatgcggtcgacattccgctggcggacccgcatttctggacgctgtccggggcggtgcgcgtggcgcagttgtgcgatgactgggggctgacctggggttgtcattccaacaaccatttcgatatttcgctggcgatgtttacccatgtcggcgcggcagcacctggtacgccaacggccatcgacacccactggatctggcaggaaggcgatgcccgcctgacgaaacagccgctggaaattaagcagggcaaaatcgccgtccctgacgcgccggggctgggcgtggaaatcgactggagccagattgagaaggcccacgagctctacaaaaccctgccgggcggcgcgcgtaatgacgccggccccatgcagtatctcatcccgggctggacgtttgaccgcaaacgccccgtctttggacgccattgattagagtaaaaggatgacagaatgagcaccactacccccgttgttacttccatgcaggtgatcccggttgccggttacgacagcatgttaatgaacctgagcggtgcccatgcgccgttctttacccgcaacatcgtgatcatcaaagataacgccggacagaccggcgtgggcgaaattcccggcggcgaaaaaatccgcaccacgctggaagacgccgccgcgctggtggtgggtaaaaccatcggcgaatacaaaaatatcctcaccgccgtgcgtcaggcattcgccgatcgcgacgccgctggccgcggcctgcaaaccttcgatttgcgtaccaccattcacgtggtgaccggtattgaagccgcgatgctggatctgctcggcaaacacctcggcgttaacgttgccaccctgctgggcgacgggcagcagcgcagcgaagtggaaatgctcggctatctgttctttgtcggcgatcgtaaacgcacgccgctgccgtaccagagccagccggacgacaaatgcgactggtatcgcgtgcgccacgaagaagccatgaccccggatgcggtggtgcgcctggcggaagcggcctatgaaaaatacggctttaacgacttcaaactcaagggcggcgtgctggcgggctttgaagaagctgaggcagttaccgcgctggctaaacgcttcccgcaggcgcgtgtgaccctcgatccgaacggcgcctggtcgctggatgaagccatcgctatcggtaaatccctgcgcggcgtgctggcctatgccgaagatccgtgcggcgcagagcagggtttctccgggcgtgaagtgatggcggaattccgccgcgccaccggcctgccgaccgccaccaatatgatcgccaccgactggcggcagatggggcacacgctgtcgctgcaatcggtggacattccgctggcggatccgcacttctggaccatgcagggctcggtacgggtggcgcagatgtgtcatgaattcggcctgacctggggttcacactccaacaaccatttcgatatctcgctggcgatgttcactcacgtggcggccgcagcgccaggcaacatcaccgccattgatacacactggatctggcaggaaggcaatcagcgcctcactaaacagccattcgaaattaaaggcggcatggtgcaggtgccgactacgccgggcctcggcgttgagctggatatggatcaggtgatgaaggcgaatgaactgtatcagaagcatggcctgggcgcgcgcgacgacgccatgggcatgcagtacctgatccccaactggacttttgataacaaacgcccctgcatggtgcgttagtgcaaccccgccggttcttgcgggaaccggcgctttcccgtgtcgggaaagataatactggcagtcaacatacctaaggacagcatatgaaaatagtgatcgcaccggactcatacaaggaaagcctgagtgccctcgatgtcgctaccgccattgaacgcggttttaaagagattttcccggacgcggagtacgtcaaactgccggtggcagatggcggcgaaggcacggtcgaagcgatggtggctgccacccacggcagaaaagtgcaggttaaggtgaccggcccgctcggcgaaccggtagcgggtttttacggtctttccggcgatgagcggagcgcctttattgaaatggccgccgccagtggtctggaactggtgcctgcggcaaaacgcgacccattaattacaacatcctgggggacgggcgagctgatccgtcacgccctcgacgcgggcgtgaaacatattattatcgggcttggcggcagtgccaccaatgacggcggcgccggaatggtacaggcgctgggcgcgaagctgttaaatgcgcaggggaagtcgctggggcagggcggcggcgaactggaaacgctggcgcgcattgacgtcagcgaactggatgcgcgcctgaaaacctgccgcatagaagtggcctgtgacgtgaccaatccgcttacgggtgaccagggggcatcggcgattttcggtccgcaaaaaggcgcgacgggcgaaaccgttgcccgtctggaccacgcgctgcaccattatgcgacgatcattcagcgcgatctggatgtggatgtgctgacgctggcaggcgggggcgcggcgggcggcatgggggccgggctgtacgcattttgcggcgcggagctgcgtcgcggcattgagatcgtcaccgacgcgctgcatctggcggagcacgttgccggtgccgatctggtgatcaccggcgaagggcgcatcgacagccagaccgtgcacggcaaagtgccggttggtgtggcgaaggtcgcgaagcgttataacaaaccggtaattggtattgccggcagcctgacggcagacgtggggatcgtccatgagcacggactggacgcggtattcagcgtcatctacaccatttgctcactggacgacgcgctgaaaaatgccggggaaaacgtacgcatgaccgcgcgcaacgtcgcggcggtgttaaaggccgggcggggattaccgccgtcagcctgacaacgtctccctctccctgcgggagagggccggggtgagagggagtattatcccaggatcttactcgcttcccgccccacgttatccatctcatccagcagttcgaggaattccggctccagatccgcggcgggcgttccgctgcgtaactggtgctcaatcagatggcagagatttttcagccgtggcacgccgctgtagccacagctgccatgcagcttatgaatggcctccgtcagtccttccggcgcttctcccaccagttgttcctccaccttattgcggatctccggcaggaaatcgagcagcatctgtaacatttcccgcgccagatcgttctttccggcggcctgacgcagcgccagctgccagtcgagggtggcgttcgggttgaccgtggctgccaccggctcaggaagcggctgcggctcaggcggcgtcagccactggctcacgccggggccgggcagatagcgcagcagcaggctgcgtaacttatcttcttcgatcggtttcgccagatagccgttcatgcccgcgctgaacagcttctctttctgatcggcgagggcatgggccgtgaccgccactaccggcgtctgctgctggtgcggcaactggcggattaactcgcaggcgcgaatgccgtccatttccggcatctgaatatccatcaggatcaaatcgaactgcatctgccgcgcccggtcaacggcctgttgcccgctttcgcacagttccacctgctgcacctgatcgtcaagcagcgcgccgatcagcttcaggttggcgggattatcatctaccgccatgacgctcatcgccagcttatccgcgttctccagcagcggcggcgcacggcggttcaggcgacaatattcattgagcgcgggcagcagtcgcgccgccgttaggggcttgagcagacaggccgccgcgccattttgtttcagctcttcggcgttaatttgcgcatggcagggcagcgccagcagcaggtaatcggtcatctgcgacgccttcgccagccgggtatgctgcatggtcagcggctcctgcagggtcaccggcaccgccagtagcagaatatcgtaatgatcttccggcagccctgacagcgtcgggctgtagatcacctccagcggcgtactgctgagtaaatccagcgtgctctgcgccgccgccgtgttcggctcaatgtaggccagccgtttacccgtaaggcacagcgttgatggcccttcgccgatgacgtttggattgagatcgagattgatgtggaaccagaaggtggacccacgctgcggctggctgtggaaagagatatcgccgcccatttcattaaccagtttttgcgtgatcaccagccccagcccggtaccgccgtgtcgccgcgaaatactcgcatccgcctgacggaacgcctggaacagccgcgactgatcccgctcgggaataccgataccggtatcgcggatctgcacctcgatctgcactttgttattactgatggagcgtttttccaccaggatgtctatgttgccgttttcggtgaacttaatggcgttacccaccagattagtgatcacctgttgcaggcgcagaggatcgccaatgacattgtccggcacgtcgttcttgatgttcagcgtcagctcaaggcccttatcatgcgcggcatgagccagcagcgtcaccacttcgtccagcgcgttgcgcagcgggaagggaatgctttcaaggatcagcttaccggcttcaagcttcgagaaatccagcacgtcattgatgatggtcagcagattattggccgagcgctcaatggtatgcagatgatctttctgggtgggcgtcagctcggatttcagcgtcaggcgggtaaagccgatcacgccgttaagaggcgtgcgcagctcatgagacatgttcgccagaaactctgacttgatgcgcgccgcttcctgcgcccgttttttcgccagatccagctcaacgttctggatctccatctgctccagcgtttcccgcagatcggaggtggcctgatcgatattgtgctgcatctcctcgtgataggccgccagcgacatcgccatcgaattaatgccgtttttcagcatatccagctcgccgagcatgaagccttccacgcggctgtccagctgaccgcgacggatgcgatcaacggtattgaccatattgcggatcgggccggtgacgtcgcgcatcagccgccagccaaagatcagggcgatgccgatacagaacagcatcatcaccgaggagacaaaaatctctttgtactgctgcaggcgcacggaacgcagatccagctccagcgccacatagcccaacatattattcgcctgcttggcatccgccgtggaagattcgtcaggtgaatacctttctgagataatcggcgtacgcaggatcataaaatcgccgttgcgcaccacgctcaagcggcgcgggaaaggcgtgcctttcgacagttttagctcgtccgggtcgagatggaaatttgaggtaacaaacagattgttacgctcatcgtaaatggagatcgcccgcacgatgtccgaatggcgacggtgcaacacgctgatgagctgcccgatagactcacggttttgcagattcatgccgtattcgctggagacggcgagcggctcaataatgctggcgccggcgtcttcaagctgacgctgtaagtcattgtagcggtggacaacaaagaagatgctgagcaacaaaccgatcagtacggtgggggccagaatcaaaatcatcatgcgcgcgcgcaggctgtagttggtcatggagttccgttatgggacaattagggcaattatgtttgattgagaaaattcccggcaatggcgcaattctactctgcaaaacgacgcgtggcgacgcgtcagatcataactgttgaagtgagcgacctcgatcctttcggtcagggcgtggctcgtcacaacggtaaagcgctgtttatccccggactactgcccggcgaacgggcggaaatcatggtgacggaagacaaacgtcaatatgctcgcgggcaggttaagcgtcgtcttaacgacagcccggaacgggaaacgccgctgtgcccgcattttggcgtctgcggcggctgtcagcagcagcacgccagcgtggcgctgcaacagcgcagtaagcgcagcgcgctggcccgcatgatgaaacgcgaggtggacgaagtgatcgccgaccagccctggggctatcgtcgtcgcgcgcgcctgagcctgaacgtggcggcaaaaagccagcgtctggaaatgggttttcgcaaagcgggttcaaacgacatcatcgacgtgaagcgttgcccgattctggtgccccgtcttgaggcgctgctgccatcattgcgcagctgtctgcagacgctggacaatccgcaccatcttggacacgtcgaactggtgctggccgataacggcccgctgctggtattgcgtcataccgcgccattaagcgccaaagatcgtgaaaaactggaacgcttttcgcattccggggacgtggcgctgtttcttgcgccgcaaagcgacatactgcaacccgtaaccggcgaggcgccctggtacacctcggacgggctacgcttaaccttcagcccgcgtgatttcattcaggtgaatgatggagtgaatcagcagatggtggcaaaagcgctggcgtggctggacatttcccctggcgatcgggtgctggatctgttctgcgggatgggcaattttaccctgccgctggcgaaacgcgctgcaagcgtggtgggcgtggagggtgtcgcggcgctggtggaaaaagggcggcaaaacgccgaacagaatgcgttgcacaatgtgacattttttcatgaaaacctggaagaagatgtcaccacgcagccctgggcgcgccacggcatagacaaagtgctgctcgatccggcgcgcgccggtgcgccgggcgtcatgcagcacataataaaacttgccccgtcaaaagtagtctatgtttcctgtaacccggccacgcttgcccgcgacagtgaagcattattaaatgcggggtaccagattcagcggctggcgatgctggacatgttcccgcacactgggcatctggaatctatggtgttatttgcacgcagtgtgagcacaggtaattaacttcggcttgtcgaattcgacaggcttcgtccctgaaaggagaggacaatggttgcggtaagaagtgcacatcttaatcgggcaggagaattcgattctgaaaaatggatcgccagtctgggaatttccagtcagccctcgtgtgaccgcttagccgaaacctgggcgtactgcctgcaaaaaacccagggccatcctgacgccgatctgctgttgtggcgcggcgtcgagatggtggaaatcctctccatgttaagcatggatattgaaacgctgcgcgcggcgctgctgtttccgctggcggacgccaacgtcgtcagcgaagacgtactgcgcgagagcgtcggtaaagccattgtcgatttgatccacggcgtgcgcgatatggccgctatccgtcagctgaaagccacgcacaacgactccgtttcttctgaacaggtggataacgttcgccggatgctgctggcgatggtcgatgatttccgctgcgtggtgatcaaactggccgagcgcgtggcgcatctgcgggaagtgaaagatctgccggaagatgaacgcgtactggcggcgaaagagtgcaccaatatctatgcgccgctggcgaaccgcttaggtatcggtcagctgaaatgggagctggaagattactgcttccgctatctgcatccggatgaatacaagcgcatcgctaaactgctgcatgagcgccgtatcgatcgtgaacattacattgatgaatttgtgggtcatctgcgcgcggaaatgaaaaccgagggcgtgaaggccgaggtgtacggccgtccgaagcacatctacagcatctggcgcaaaatgcagaaaaagcagctcgcctttgacgagctgtttgacgtgcgcgcggtgcgtattgtggccgagcgcctgcaggactgctatgcggcgctgggtatcgtacatactcattatcgccatctgcccgacgagtttgacgactacgtcgccaacccgaaacccaacggttaccagtccattcacaccgtggtgctggggccggggggcaaaaccgttgagatccagatccgtacccgtcagatgcatgaagatgccgaactgggcgtggcggcgcactggaagtacaaagaaggggcagccgcgacaggcgcgcgcgcgtccggccacgaagatcgcattgcctggctgcgtaagcttatcgcctggcaggaagagatggccgactccggcgaaatgctcgacgaactgcgcagtcaggtgttcgacgatcgcgtttacgtctttacgccgaaaggcgatgtggtcgacttaccggcaggctccacgccgctcgacttcgcctaccacattcacagcgacgtcggccatcgctgcatcggggcgaaaatcagcggacgcattgtgccctttacctatcagcttcagatgggcgatcagatcgaaatcatcacccagaagcagccgaaccccagccgcgactggctgaatcctaaccttggctatgtcaccaccagccgcggacgggctaagatccataactggttccgcaaacaggatcgcgataaaaatattctcgccgggcggcagatccttgatgacgagcttgaacatctggggatcagcctgaaagaggcggaaaaacagctgctgccgcgctacaacttcaacgaagtggaagagctgctggcggcgattggcggcggcgacattcgccttaaccagatggttaacttcctgcaggcgcagtttaataaaccgagcgccgaggaacaggacgccgctgcgcttaaacagttgcagcagaaaacctgggcgccgccgcaccgtaacaccaacaaagataaaggccgcgtggtggtggagggcgttggtaatctgatgcaccacatcgcccgctgctgccaaccgatccccggcgatgagatcaccggttttatcactcaggggcgcggcatctctattcaccgcgccgactgcgatcagctgaccgaactgcaatcccacgcgcctgaacgtattgtcgacgcggtatggggcgagagctactcggcgggctattcgctggtggtgcgcgtgaccgctaacgatcgcagcggtctgctacgcgatatcaccaccattctcgccaatgagaaggtcaacgtgctgggcgtggcaagccgtagcgacaccaaacagcagctggccaccattgatatgaatatcgaaatctataatctgcaggtgcttggccgcgtcctcggtaaactgaatcaggtgccggatgtgatagacgcgcgtcgcctgcacggcggttaattttactttttcggcccgatggcgaattgctgtcgggcctgtgttttcaggacattccaatgacgcaaatcgatcgcctgctgggcatcatgcaacgcctgcgcgacccggaaaacggctgcccgtgggataaagagcagacctttgccaccatcgccccttacaccctcgaagaaacctatgaagtgctggacgccatttcccgggaagattttgatgatctgcgcggcgaactgggcgatctgctgttccaggtggtgttttacgcgcaaatggcgcaggaaggggggcgttttgacttcaatgacatttgcgcggcaatcagcgacaagctggaacgccgtcacccgcatatctttggcgatgccacggcagaaaacagtactgaggtattagcgcgctgggagcaaattaagcacgaagagcgcgccgaaaaagcgcagcattcggtgctggatgacatcccgcacagcttcccggcgctgatgcgcgcgcataaaattcagaagcgctgcgcctcggtcggctttgactgggccaccctcggcccggtggtggaaaaagtttacgaagagatcgatgaagtgatggacgaggcgaaacaggcggtcgtcgatcaggcgcgggtggaagaagaaatgggcgatttgctgttcgccaccgtgaatttatcccgtcatctgggcgtcaaagcggaagtggcgctgcaaaaagcgaacctcaaatttgagcgtcgtttccgggaagtggagcgtattgttgctgcccgcgggctgagcatgaccggtgttgatctggaaaccatggaagaagtctggcagcaggtaaagcggcaggaatctgatctctaacgacttttgcggatcaagcgcgatttgtgtgattttttaaataacaagcgcttgatttgcgtcaaaaacatttagccaaaaggggctattttctcactccttattattgtcagaacctgtggaagaggaggaagaatgaaagtttgtggcaactgcccggttccggtatactgctttcccgtcctggttattccatcgtcttttaaacctaacttctcaggttcagcatgacaacgaactatatttttgtgaccggcggggtcgtatcctctctgggaaaaggcattgccgcagcctccctcgcagccattcttgaagcccgtggcctcagcgtaagcattatgaaactggatccgtacatcaacgtcgatccgggcaccatgagcccaattcagcacggggaagtgttcgttactgaagacggcgctgaaaccgatttagacctgggccactacgagcgcttcattcgcaccaaaatgagccgccgtaacaacttcactaccggtcgtatctactccgacgtgctgcgtaaagagcgccgtggcgactatctgggcgcgaccgttcaggttattccgcacatcaccaacgccatcaaagagcgcatcatcgaaggtggcgaaggctacgacgtggtgctggttgaaatcggcggcacggtaggcgacatcgaatccctgccgttccttgaagcgattcgccagatggccgtggaagtgggccgtgaacacaccatgtacatgcacctgacgctggtgccatacatggcggcggcaggtgaggtgaagaccaaaccgacacagcattctgtgaaagagctgctttctatcggtatccagccggatattctgatttgtcgctcagatcgcgcggttcctgccaacgaacgtgcaaaaattgctttgttctgtaacgttccagaaaaagccgttatttctctgaaagacgtcgattctatttataaaattccgggcctgttgaaatctcagggactggacgattatatttgtaaacgattcagcctgaactgtccggaagctaacctgtctgaatgggaacaggttatttacgaagaagcgaatccggcgggtgaagtcaccatcggcatggtcggcaaatacattgagctgccggatgcctataaatcggtgatcgaagcgctgaaacacggtggtctgaagaaccgcgtaaccgtcaacatcaagctgatcgattcgcaggatgtggaaacgcgcggcgttgagatcttaaaaggtctggacgcgatcctgatcccgggtggtttcggctaccgcggcgttgaaggtaagatcgccactgcacgctttgcgcgtgaaaataatattccttatctgggcatttgcctgggtatgcaggttgcgctgattgagtttgcgcgcaacgtagcgggaatggacaacgccaactcaacggaatttgtgccagactgtaagtaccctgtcgtggcgctcattaccgaatggcgtgatgaagatggcaatgtcgaagtccgcactgaaaagagcgacctgggtggtacgatgcgtctcggcgcacagcagtgccagttggatgacgacagcctcgttcgtcagttgtacggtgcgtctaccattgttgaacgtcaccgtcaccgctatgaagtcaacaatatgctgttgaaacaaattgaagctgcgggtctgcgtgtcgcgggccgttccggcgatgatcagttagttgagatcatcgaggtgccaaaccatccgtggtttgtcgcctgtcagttccacccggaatttacttcaacgccgcgtgatggacatccgctgtttgcaggctttgttaaggccgcaagcgatttccagaagcgtcaggcgaagtaagagttagaacgacaatgcaccctgccgggtgcattgtttgtctggagttttagtttaacttgtactgaggaaatcctaatgtccaaaatcgttaaagtcatcggtcgtgaaatcatcgactcccgtggtaacccgactgttgaagccgaagtacaccttgaaggtggtttcgtcggtatggctgctgccccgtcaggtgcttctactggttcccgtgaagctctggaactgcgcgatggcgacaaatcccgtttcctgggtaaaggcgtaaccaaagcggttgctgcggttaacggcccgattgctcaggcagtgcttggcaaagacgccaaagaccaggctggtatcgataagatcatgatcgatctggacggtactgaaaacaaatctaacttcggtgcgaacgctatcctggctgtgtctctggctaacgccaaagccgctgcggcttctaaaggtcaggcgctgtacgagcacatcgctgaactgaacggcactccgggcaaatactccatgccggttccgatgatgaacatcatcaacggtggcgagcacgcagataacaacgttgatattcaggaattcatgatccagcctgttggcgctaaaacgctgaaagaagctgtgcgtatgggttctgaagtgttccacaacctggctaaagttctgaaagctaaaggtatgaacactgcggttggcgacgaaggcggctacgcgccgaacctgggttccaacgctgaagcactggctgttatcgctgaagcggttaaagcagcaggctacgaactgggcaccgacatcactctggcgatggactgcgcagcgtccgagttctacaaagacggtaaatacgttctggccggcgaaggcaacaaagccttcacctctgaagaattcacccacttcctggaagatctgaccaaacagtacccgatcgtttccatcgaagatggtctggacgaatctgactgggatggtttcgcataccagaccaaagtgctgggcgacaaaatccagctggttggtgacgatctgttcgtaaccaacaccaagatcctgaaagaaggtatcgaaaaaggcatcgttaactccatcctgatcaaattcaaccagatcggttctctgaccgaaactctggctgcgatcaaaatggcgaaagacgctggctacaccgcggtgatctctcaccgttctggcgaaactgaagatgcgaccattgccgacctggcagtaggtaccgctgcaggccagatcaaaaccggttccatgagccgttctgaccgcgttgctaaatacaaccagctgatccgtatcgaagaagcgctgggcgaaaaagcaccgtacaacggtcgtaaagagatcaaaggccagtaattctgccttttaatctgattgataaatgccagtctacggactggcatttttttacctattttttgcgaagttccgggcacgaaccaataaatgtgagttatatcaagctaaaatttttatttgcagtgtagtttagcaataataatatatagtgttattggtgcagtgaattagtatttgataaggatagttttatattatggatgatgatgaaataaaaatattcatgattaaatctggagtgaaaaaaagagaggctgcttttctgattaaattggcaaaaaggaaaaagatcagcataggaagggcattctttctctatgtatggaaatattatgcctggagtggtgtattgttattatctgtgatttttggctcgatagctggtggagtggagtcctttttagttaactttcttttttgcagcgtgattgcttttttatccttattctttacacctttttttatgaatttagtatggagtattaaaattcaggttaagttgattgggaaatgacaggaggttttaatgtgcagttatggactaatgaatttgcagcgtgaagaagagaaagttagtaggcttgtatttgacattggttttaaatatttacatggaatcaaattacgttcgagatttatgtgtgaagagaattctctttcgaaagaatatattaatgactatctttcaggaaaaataattttttctgaagcaatgaaccggttacgaagtcagtatgaacgtttgattcgaaaccaaagccaattacagatgggaagcataaagttatatgctatcgcagagcgcgaaaaagacaggcattcgcttttaacgattacgctcaagcgagtgggttttgttagtggctcgatgcaggcaatcgggggattcggaatatgcaaggcgaatattggagctgcatgtagatattttggtgttcctttaatgatccagggaagtgaaaatgtctgggagaatggctactacttgctttatcacgaggatccaaaagtagtgcctgtacgttatgcttatcggcaggctgctaagtttttcggtggtgaaggaagggatggtgacatcgctttttcaagtggagatattgccctttctctcgggtcggcatcgacattgacattaaagtctgattcatggaaattattccactatattcgggaggattatatccataactggagaacattgggcgctgtcggcggaatcaatgaattagcgggtgatgcagccagtggattttctatttatcagattgcgggagtggggagtacaaactgggaggcgttggggaggtaaacagatgcatgaaaaaaaatatgatccgaatgatagagatttagtcgaaagggtaatgaacacaggattaagtgaatataaaacgcaaaaaattattaacgctgccaatgcaaaagggttaagcttacaaaaaacgtatcggctaacggaagcaagaatattcagcgtagatgtcattattgctacgattatgcttttttttattatctcgatagtgttactcgatcctggcgctttgtgggtgttcatttttgtatttgggcttctatttataacgattgaagtagtagttcggtctcataaaaattactggaagatgttgaaaatctatcacggtcttagggggttatgaaaccttcttctatacagaatcattataatagatgttctttacctcaattatagtgaatgcgtgctgatataaaagagaggaattctgcaaaaaccaatagtgactcatatcgaatttgtagtcttccccaatgtattagcgttctacagcagcagcggtaaggtcgcgctggcggtttgctggctggtatcgctgtaatgcgcgtcataagacattaaagcagtgatcagcagttccaccagcagcatggcccccactttggcattcagcgccccggcgctgagcggcccttcaggtttcgccgccaccagcagcatatcgctgatcgacgccagcggactgcgcggcgtattgcttaacgccagcaccgtcgcaccacgtttacgcgccagtttcaccacatgcagcagatcgcgcgtggagccggaactggagatcgcgatcaccagctcatcacttcccagcgtggtggcattcatcgccgcgcgatgcatatcgctgaacagctgcgccgttttgccgaggcgtaaaagtttgtagtgcagataatcgccaatgatggcgctggccgccacgccgtaaatctgcactgtgcgcgcctgatgcagtgtcattgccgccctggccagcacctcgcggtcaagcagcctcgacgtatcccgcagcgccatgaccgactcttccaccagcgtatcaatctcatcgccctgctcacgcggcgtcccggcgcgctgcacatccagcgccagcgccattttgaattccgtatagcctttgcagcccagcacacgacacaggcgcgtcacgctggcttcgctggtggcgctctcccgcgccagctcggtgatggtctgataaagcacccgcgaaggttctgccagtatgtattccgtcagcttctgctgcgtggggctgtaacccgacattccctggcggaggcgcagcagcacattttcattttcagacattccgggatcctttacgtcgttaatgcccgatagtgtggcggaaagaggggacaggttgccagtcattttaaaatagtatgatccgcttccgcttttttggtgataattttcacgttaaatatttattgtggtaaaaattttcatcaacaagcagcgagcggagatagagtatgacaatgttcagtggtgcctcccccgggggctggtttgaaaaagcgcagcgttttggtaaatcttttatgctgccgattgccgtacttccggcggcggggctgctgttggggattggcggcgcgctgtcgaatcccaatacgctgacggcctggcctttcctggatgtggcctggctacaggcgattttcaccatcatgagcagcgccggggcgattgtttttgccaacctgtcggtactttttgcggtgggcgtggcggtggggctggcgaaaaccgataagggcacggcgggactggccgcgctgctggcgtatctggtgatgaatgccaccattaatgcgctgctgacgctcaccggtacgctggcgagcagcaatcccggcgcggtcgggcagggcatgaccttaggtattcagacgctggaaaccggcgtgtttggcggcgtggtcatcggcctcgtcacctgcgcgctgcatcaccgctttaataagatcgcgctgccgcagtttctgggcttttttggcggctcgcgctttgtacccattatcagctcgctggcggcgatccttgtcggcgctatcatgacggtggtctggccgcattttcaaaagctgattttcggtcttggcgggctggtggatgccaccggctacctaggcacttttctctacggctttattttgcgcatgcttggccccttcgggctgcatcacatcttttatctgcctttctggacgacggcgctgggcggcagcgagatagtcaacgggcaactggtggaaggcacgcagcgcattttcttcgcgcagctggccgatcccgcgacgcagcagttttacgaaggcacctcacgctttatgtccggccgcttcatcaccatgatgttcgggctggtgggggcatgtcttgcgatgtaccacaccgcgaaacccgaaaacaaaaagcgggtagctggcctgctgttctcggcggcgctgacgtccttcttaaccggcattaccgaacctattgagttttcgttcctgtttgtcgcgcctgtgctgtacgttctgcacgcgttgttcgacgggctggctttcatgctggcgcatatgctgcatatcactatcgggcagacattttccggcggctttatcgactttgtgctgttcggcattatgcagggcgaagcgaagacccactggctgtatgtgccgctggtcggcattccgtggttcttcctgtactacttcacctttcgcttcctgattaagcgctttaacttcctcacgccaggccgcgaaaaagagcaggcggaaatcgctgccgtcagcggcaccgaacgggcagaagccatagtggcggcgctgggcgggcgcgggaatctggacgaggtcgactgctgtgccacacgcctgcgcgtaacggtaaaagcgggcagcaaagtggatgaagccgccctgaaagcgacaggcgcgcgcggggtgatcgttcgtggtaacggggttcaggtgatttacgggccgcacgtcaccatcatcaaaaacgaaatggaagagatgttagcgttatgaatgcattagaacagatcaaaaaggcgctggtggtgtcctgccaggcgctggaaaacgaaccgctgcacagcgattttattatgtcccgcatggcgctggccgcagtggaaggcggtgccgcaggtattcgcgccaacagcgtggtggatatcaaagccatcaaggcgcaggtgtcgctgccggtgatcggcattatcaagcgtgattaccctgacagcgacgtgtttatcaccgccacgctgcgcgaaatcgacgagctgatgacggtcgccccggaaatcatcgcgctggatgccacccagcgtaagcggcctggcggcgacaccctggccgcgctggtcagtgcgatccgccgccgttatccgcaggtcttgctgatggcggatatcgccaccctggatgatgcgcgtattgccggtgagctgggctttgactgcctcggcaccaccctttatggctatacggctgaaacggcgggacgccggctaccggaaaacgatctgcaatttttaaaagaggtactttccatcgccactatcccggtgatcgccgaaggcaatgtcgacacgcctgagcttgccgcgcagtgccttgcgctgggggcgcattcggtggtggtgggcggcgccatcacccggccgcagcaaattaccgcgcgttttacccgcgcgattaatgcgcagggcgcgaatggcacatgatcgtctggccgggatctgcgatacttagggtttagatcctgaacagagatgagtatgcagtacccgattaatgaaatgttccagaccttgcaaggcgagggttactttaccggcgttcctgccatttttattcgtttgcagggatgcccggttggctgtgcctggtgcgacaccaaacacacatgggacaagctctccgatcgggaagtgtcgctctacagcgttatcgccaaaaccaaagagagcgataaatggggcgcggcgagcagcgaagatttgctggctattatcagccgtcagggttacaccgcgcgtcatgtggtgatcaccggcggtgagccctgcatacacgatctgctgccgctgacctcactgtttgagaagaacggttttagctgccagatcgaaaccagcggcacgcacgaagttcgcaccacgacgggcacctgggtcacggtatcgccgaaggtaaatatgcgcggcgggtatgacgtgctgacgcaggcgctggagcgcgccgacgagatcaaacatccggtaggccgtgtgcgggatattgaagcgctggatgaactgctggcgcgtcttgacgatgacaaaccccgcgttatcgccctgcaacccatcagtcagaaagaagacgccacgcgtctgtgcatcgaaacctgtattgcccgcaactggcggctgtcgatgcagacgcataaatatctgaacatcgcctgaccagacgccctctcccacgggagagggtgatatgacaggagatcactccccgcgataaatacagcccgccgtacaggtttctttcaccatcaccgcgctcagctgcggcaccagcggcttcatttcgttccagatccacgcggccagcacttcgctggtcgggttctcaagccccggaatatcattcagataatagtgatccaggcggtcatatgtcggcttaaacgcgcgttttagctcggaaaaatccatgatccagccggtatgcggatcgacttcaccggtaatttccaggcgcaccataaaagagtgaccgtgcaggcgaccacatttatggccttccggcacgtgcggcaggtgatgagcggcttcgaaggtgaaatctttaaacaaggtggtgatcattatcatttctctgtaaggcaaaaaccgccgtagggtagcggatatgaccttttttagcattaacaaaaaccggtaaaagtgtttaaccaaagtatttgtcagggttatgggttttttattattaaaattcaaagatttaattgaccggttttagtgttaataactatagctaaaagaggttagtcattttggttatttgttatttccaacccttctttagttgttattattcgcgccgttaaccttactctctgttctgtttttcccccttataaaaacggcttttactggaactggacgacgcatgacgactcaggccccaccttccgctttgctgccgcttaacgcggagcaaatgtcgcgcctaacggcggtgacatccgaacttactccgactcagcttgcctgggtttccggctatttctggggcgtgcttaatcagcagcctggaaccgttgcgggcacaaccacgcctgccgcgcctgccgcgaaagaaacgccagctatcacgctgatttccgcctcgcaaaccggcaacgcccgccgcgtggcggaagccctgcgcgatgatctgctggcggcgaagcttaacgtcaacctggtgaacgcgggcgactataaattcaaacaaatcgctcaggaaaaactgctggttgtcgtgacctccacgcaaggggaaggggagccgccggaagaagccgtcgcgctgcacaagttcctgttctcgaaaaaagcgcccaaacttaacggtacggccttcgccgtatttggcctgggcgattcctcttatgaattcttctgccagagcggcaaagattttgacagcaagctggcggagctgggcgctgaacgcctgctcgaccgcgttgacactgacgttgaatatcaggccgctgccgccgaatggcgcgggcgcatcctggacgttctgaaatcccgcgttccgcaggaaagcccggcgcaggctgcggctaccgccagcggcgtggtcaacgaagtcacttccagcccctatactaaagaagcgccgctttgcgccacgctgtcggtcaatcagaagatcaccgggcgcgattccgaaaaagatgtgcgtcatctggagatcgatctgggcgactccggcctgcgctatctgccgggcgatgccctgggcgtgtggtatcagaacgatccggcgctggtcaaagaactggttgaactgctgtggctgaccggcgacgaacaggtgaatgttgatggcaaaactctgccgctgtccgaggcgttgcaatggcattttgagctgacggtgaataccgtcaacatcgtggaaaactacgccaccctgacccgcagcgaaacattactgcctctggtgggcgataaagcgaagttgcagcactacgccgcaacgacgccgattgtcgatatggtgcgtttctccccggcgcaactggatgccgacgcgcttattggtctgctgcgtccgctgacgccgcgcctgtactccatcgcctcgtcccaggcggaagtggaaagcgaagtgcacattaccgtgggcgcggtgcgttttgacattgaaggccgcgcgcgggctggtggcgcctccagcttcctcgccgatcgcgtggaagaagacggcgaagtgcggatctttatcgaacataacgataacttccgtctgcctgaaaacccggaaacgccggtgatcatgatagggccgggtaccggcatcgcgccgttccgcgcctttatgcaacaacgtgctgccgatgaggcccccggtaaaaactggctgttctttggcaatccgcactttacggaagactttttataccaggtggagtggcagcgctacgttaaagacggcgtgctgaaccgcatcgacctggcctggtcccgcgatcagaaagaaaaaatatacgtacaagacaaactgcgcgaacagggcgcagagctgtggcgctggatcaatgacggtgcccacatttatgtctgcggcgacgccaatcgtatggcgaaagacgttgagcaggctttgctggatgtgattgccgaattcggtggcatggataccgaagcggcggatgaatttttaagtgagctgcgcgttgagcgccgttatcagcgagatgtctactaatgagcgaaaaatatccaggtccgctggtggtcgaaggaaaactgactgacgccgagcgcatgaagcgggaaagcaactatctgcgcggtactattgcggaagatttacataacggtctgaccggcggtttttccggtgacaacttcctgctgatccgttttcacggcatgtaccagcaggacgatcgcgacattcgcgccgaacgcgccgagcagaagctggagccgcgccacgcgatgatgctgcgctgccgtctgccgggcggcatcattacgccgcagcagtggctgtcggtggataaattcgccaccgaaaaaaccatctacggcagcatccgtctgaccaaccgtcagacgtttcagtatcacggcatcctgaaaaagaacgtcaaaccggcgcaccagatgctgcacgaagtggggctggacgcgctggcaacggcgaacgacatgaaccgtaacgtgctttgcacctctaacccggtggaatcgcagctgcacgctgaagcctacgaatgggcgaaaaagctctctgagcacctgctgccgcgcacccgcgcctatgcggaaatctggcatgatgccgagaaagtggcgaccaccgacgaagaacccattctcggtcagacctacctgccgcgtaaatttaaaacgacggtggtgatcccgccgcagaacgacatcgatctgcacgccaacgacatgaactttgtcgccattgccgaaaacggcaagctggtgggctttaacctgctggtaggcggcggattgtccattgagcacggcaacaagaaaacctacgcccgtaccgcgactgaattcggcttcctgccgctggagcatacgctggcggttgccgaagccgtggtcaccacgcagcgcgactggggcaaccgtaccgatcgtaaaaatgccaaaaccaaatacacgctggagcgcgtcggcccggacgtcttcaaagcggaagtggaacgtcgcgcgggcattaaattcgcgccgatccgcccgtatgaatttaccggtcgcggcgatcgtatcggctgggtgaaaggcattgatgataagtggcacctgacgctgtttatcgagaatggccgtatcatggattacccggatcgtccgctgaaaaccggtctgctggagatcgcgaagatccacaaaggcgacttccgtttaaccgccaatcagaacctgatcgtggcgggcgtaccggaaagcgacaaagcgaagatcgaaaagctggcgcgcgatcatggcctgatgaacgccgtgaaaccgcagcgcgaaaattccatggcctgtgtcgccttcccgacctgcccgctggcgatggcggaggccgagcgtttcctgccgacctttatcgataaagtggaagcggtaatggaaaaacacggcctcggccatgagcatatcgtgctgcgtgttaccggttgcccgaacggctgtggccgtgcgctgctggcggagctggggctggtcggtaaagcgccgggacgctacaacctgcatctgggcggcaaccgtatgggcacgcgcatcccgcggatgtaccgtgaaaacatcaccgaaccggaaattctcgacaccatcgatgaactggtggggcgctgggcgaaagagcgcgatgccaacgaaggcttcggtgatttcaccgttcgtgctggcatcatccgtccggtgctggatccggcgcgggatttctgggaataacgtaacacgccggatggcggcgtgaacgccttatccggcctacagggctaaaccgtaggccgggtaagcgtaagcgccacccggcacacccgccattctgtaggccgggtaagcataagcgccacccggcataagtgaggaatctatgtccgtactcgatctaaacgcgctcaacgatctgccaaaagtagaacgcgtactggccctcgccgaaacgaacggccagcttgaaaaactcagcgcagaggagcgcgttgcctgggcgctggaaaatctgccgggcgaatatgtgctgtcgtcgagctttggtattcaggcggcggtcagcctgcatctggtgaatcagatccgcccggatattccggtcatcctcaccgataccggctacctgttcccggaaacctaccagtttattgacgagttaacggacaaactcaaactgaacctgcaagtgtatcgcgcgaaagagagcgccgcctggcaggaagcacgctacggtaaactgtgggagcagggcgtcgaaggcatcgaaaagtacaacgacatcaacaaagtcgagccgatgaaccgtgcgctgaaagagctgaatgcgcagacatggtttgccggcctgcgccgtgaccagtccggcagtcgtgccagcctgccggtgctggccatccagcgcggcgtttttaaagtgctgccgattatcgactgggataaccgcaccgtcttccagtacctgcaaaagcatggcctgaaataccatccgctgtgggatcagggctacctgtcggttggggatacccacaccacccgtaaatgggaaccgggtatggctgaagaagaaacccgcttcttcgggctgaagcgtgaatgcggattgcatgaaggttaatcaataaatatccctccgcccggcagtgcaattctgccgggtgtcacttcttatatactgacgttgtgattatatggttggtatctgttcattcttttttgtaaagcaatacttgctagcttcatcttaccaggttcgcatcagctgtattacatcaagattcactgcccaaatattctttggaaatttacaggtgatgatttacagaagtgcattacaatcccaaaatggaccaagaaatgcgggttggttcgaggaaaatcaacgtgacactattgtttgatttttagacgaacattcgtgaacgagccattcaacgagagaacatctcctgaataggttatgtcgatgtcaccattttgatcgaccctggcctcgctgacgctaccgcgaccctcaatgacaggtcttcccatgctaagctggcgaacaacctcttcatcactgccgctgagatggtctgccagatagtaacggtaaactgtcggaacggttgccccgccatcgcggctaacagtcatatacagccattgatgatcggacaactgataagcgcgcttaagctcgtcgttcaccctgacgttcggctgatgattgagccaccagaaccccacgatcagtacgaaaagaaccagtgtcacgactctatgcagccatttaatagccgttctgaatggcatattcgatcccttcctgaatatagcgctgatcggttgggtcatcgccataaggaggcttttcgtgccactgcccccactctggtttagacgtacctgcgcgactctgggcccatcccgctcccataaggagtattcgcgcaggaattccggcagctgtgccagctgcgccaaaattgaaattaccgaatgcctgaaaatatgggtcaaactgtttatagtcccatggcccaccacggcgaactttctcataaaaccaatagtaggttgacgccgtcgccatgttgcgcgacatccctttttgacgagcctcgcgcatattattagcgataacgatagaacctggaccgggaattgggacggatgccataaaatctccttattttttcgcttcaaagctccctgaataaatgaaatacctccaatttaataccgaggatacatattcaccaacaaaaaaaacattacactttgtattgttattgggcaagtttttgccgcgctttattgtgattttcatcacggaggtattcgccccttttaggctcgaatacatctgccctctcgcttaacggcgcagaattgtttatctatattttttggtttgctgaggaacgtttctactttcccctttaagtcatacttctacgccagtccagcagcaccgtaatgttatccattacgttatctttggcttaaaaagtctcccgcagagtagttaagtaacgtcagagaatgcgtgtatatgtatcctctgcgacatgctaaaagtgagcatgatgtatttgcttagctgccagccctcaccgattctggaagttgaatttatgttacccttatgagtaagaatgcctttatcaggcattcccgattcacactttttaaaaccatcaagcaatttacgttttcgcccgtgccagttccttcaccagcggcagcatgatgcgcattacgtcgcggctgcggcgttcgatgcggcctggcagggcgctgtcgatgtgctgctggttatccagacgcacatcgtgccaactggtgccgtccgggaatgaacgggttttggcgcgctgctggttaccgtctttattgcccagcgaccagtttgtcgcttccaccgacagcaccggaatttttgctttatcaaacacctcaacatcgtggcagcacgacgtgcctttcgggtattgcggattcaggccaggattggtggcggcggcgatgccgcgactgcgggcaatggccagcgcgcggtcgcgggtcagcttgcgtaccgaggcgggggtatttttgccgctgttgaaatagagcttatcgccgacgatcagattatcgagattaatcaccagcagggtatttttccgctctgcctcgctcatgcgcttcagaaagttttccgcgccgagctggccttcctcctcgccgctggtggcgacaaaacggatactgtactgcgtcggaacatctttcagcgcgtcggccagctccagcatcacgccaacgccggcagcgttatcgtccagcccctgtaaggtcaggccgccgagattgttatcaatatccgcatcgctgcgcggcgcgtaggtgtcgaggtgcgccatgataataatctgctcaggctgcttgccctcatgcgcggcgatcaccgtgctgccggtaatgttgtgccagttacgctgattggttttcgaggtatagataaagcggctggtgaacttgcggatatcgctctggtaacccatttgcgcaaactgctgtcgcacataatccgccgaaagcatctctgccggcgtgccggtcatacggccggggaaataggttgcaatataacgtgcctggtggcttgccatgtcaccgggaggcagcaacgccgcctgaacgggaagagtaaagcatacgccgaacgccagggcagcggtacggtggcgcaatgcggaaaacatagtgagtccttaaacatgccggaaatttttgaccggcttagtatgaaactgtgatcggccttacacaatttgaattgcgcctaaacgcacgaattttctggcgttaagcactttttgatatttgctttcccgcgccgttattcctttgcggaactactcattccaattcgtaatttcattcgctcacagccgccccctatagtccccttattcctgaatgttagcgagctgttaccttgtggatcacctgcccatttttgctgcggtaaaaaaccgacccgtgctggttattggcggtggcgaaatcgccgcccgtaaaattgcgttcttattacgcgcgggggcgaaggtgcaggtcgtcgcccgtgaactgggcgcagaggtgcagcgtctggtggatgaacaggcgctggtgtggctggcaaccgagttcgatgaaacgcagcttgatgctgtgtttctggtcattgccgccaccagcgaccgcgcgcttaatcgtcgcgtctatgacgccgccgacgcccgccagcggctggtgaacgtggtggacgaccagccgctgtgctcctttattttcccgtcaatcgtcgaccgcagcccgctggtggtggcgatctcctccggcggtaacgccccggtgctggcgcgtctgctgcgggaaaaaatcgaagcgctgcttccggcaaatttaggccgcatggcggaggttgccgggcagtggcgcgagcgcatcaaaacctttcgtaaaaccacagacgcgcgtcgtcgtttctgggaagcggcctttcgcgggcgcttcgccagcctgatggctgccggaaacgaacaggccgccgaagcggtgctggcggaagagctggcatcgccaggcagtgctggcggggaaattatcctggtgggcgcagggccaggcgatgccgggctgctgacgctgcgcggtctgcaggttattcagcaggctgacgtggtgttttatgaccatctggtcagcgatgaggtgctggagctgacgcggcgcgatgccgacaaaatctgcgtcggcaaacgggctggcggccatgcggtgccgcagcatgaaaccaatcaaatgctgattgatgaagcgcgggcgggcaaaaccgtggtgcggctgaaaggcggcgatccctttatttttgggcgcggcggcgaagagcttcaggctgctgccgctgcgggcgtgcctttccaggtggtgcctggcgtcactgccgcttccggcgcaacggcttacgcaggcattccgctcacgcaccgtgattttgcccagagcgtgacctttgtgaccgggcattacaaagccgacagcacgcctttcgactggtcgcagctggcgcagagccgtcagacgctggcggtgtatatgggcaccatgaaggcggcggaaatcagccagcaacttatttcgcacggtcgcgataaagcgacgccggtggcagtgatctcgcgcggtacgcgccgcgatcagtcagtcaaaaccggcacattagaacaattagagaacctggcgcttaacgccccgatgccagcgctgctggtggtgggcgaagtggtgcacttacgcgatgcgctcgcctggtttcaacactctacaggcacgggatcttttgataactccgtggtaaatctggcttaaggaacggttatggatcaaaaacgactcactcacctgcgacaactggaggcggaaagcatccatatcattcgcgaggtggcggcagaatttggcaatccggtgatgatgtattccatcggcaaagactccagcgtgatgctgcatctggcgcgcaaagcgttttatccgggcacgctgccgttcccgttgttgcatgtggatactggctggaaattccgcgagatgtatgagttccgtgatcgcaccgccaaagcttacggctgcgagctactggtgcataaaaaccccgaaggcgtggcgatgggcattaatcccttcgtgcacggcagcggcaagcacaccgacatcatgaaaaccgaagggctgaagcaggcgctgaacaaatacggttttgatgcggccttcggcggcgcgcgccgtgacgaagagaaatcacgcgccaaagagcgtatttactcgttccgcgatcgtttccaccgctgggatccgaaaaaccagcgcccggagctgtggcataactacaacggccagatcaacaaaggcgaaagcattcgcgtattcccactctccaactggaccgagctggatatctggcagtacatcttcctcgaaaatattgaaatcgtaccgctgtacctggccgctgagcgaccggtgctggagcgtgacggtatgctgatgatgatcgatgacgatcgcatcgacctgcaaccgggcgaaaaaattgagcagcgcatggtgcgtttccgtaccctcggctgctggccgctgaccggcgcggtggaatccgaagcgcaaacgctgccggagatcatcgaagagatgctggtgtccaccaccagcgaacgacagggacgcgtcattgaccgcgaccaggccggctctatggagctgaagaaacgccagggttatttctaaggagccgccatgaatacgactattgcacaacaaattgccagcgaaggtggcgtggaagcctatctgcatgcgcagcagtacaaaagcctgctgcgttttctgacctgcggcagtgtcgatgacggtaaaagtacgctgattgggcgtctgctgcacgatacccgccagatttatgaagatcagctctcgtcgctgcataacgacagcaagcgtcacggcacccagggcgaaaaactggatctggcgctgctggtggatggtttacaggccgagcgcgagcagggcatcaccatcgacgtggcctaccgctatttctccaccgaaaagcgtaaatttattatcgccgatacgccgggtcacgagcagtacacccgcaatatggcgaccggcgcgtccacctgcgacctggcgatcctgctgatggatgcgcgtaaaggcgtgctggatcagacccgccgccacagctttatctccacgctgctggggatccgtcatctggtggtagcggtgaataaaatggatctggtggaattcagcgaagagaaattcaatcagatccgcgaagagtatctgaccttcgccgaacagctgccgggcagcctcgacatccgctttgtgccgctgtcggcgctggaaggcgataacgtggcgagtcagagcagtaatatgccgtggtacagcggcccgacgctgctggaggtgctggaaaccgttgagatccagcgcgtggtggagacgcagccgatgcgttttccggtgcagtatgtgaaccgccccaatctcgatttccgcggcttctccggcaccattgcctccggcagcgtcaacgttggtcagcgcgttaaagtgctgccgtcgggcgttgaatcgacggtggcgcgtatcgtcacctttgatggcgatctgcaacaggccggggcaggggaagcggtcacgctggtgctgaaggacgaaatcgacatcagccgcggcgatttactgctggatgcgcaggacgggctgaaagcggtgcagagcgcgtcggtagacgtggtatggatggcggagcagccgctgacgccgggccagagctacgacatcaaagtcgccggtaagaaaacccgtgcgcgcgtcgatggcattcagtatcaggtgaacatcaacaccctcgaacataatcaggctgaaaacctgccgctgaacggcatcgggctggtggatctgacctttgacgaaccgctggtgctggataagtaccaggaaaacccggtgaccggcggcatgatcctgatcgatcgtctgagcaatgtcaccgtgggcgcaggtatggtgcgggagccgaacgagcaggcaaaccatgcgccgtcggaattcagcgcctttgaactggaattaaacgcgctggtgcgtaaacacttcccgcactggggcgcgcgtgatttgctgggaggcaaataatggcgcagcacgatgaaaacgtcgtctggcatccgcatccggtgaccgccgggcaacgagaacaactccacggtcatcgtggggttgtgctgtggtttaccgggctgtctggctcggggaaatccaccgttgccggggcgctggaagaggcgctgcacgggcttggcgtcagtacctatctgcttgatggcgataacgtgcgccacgggctgtgcagcgatctgggcttcagtgatgatgaccgcaaagagaacatccgtcgcgtcggggaagtggcgcgtctgatggtggatgccgggctggtggtattgacggcgtttatctctccgcaccgtgcggagcgtgaaatggtgcgcgaacgcgtcggggaagggcgctttattgaggtgttcgtcgacacgccgctggccatctgcgaagcgcgcgatcccaaagggctgtacaaaaaagcccgtgccggggaactgcgtcactttaccggtatcgattcggtctacgaagcgcctgaaacgccggatgtgcatctcgatggcgaacaattggtaacaaatttagtgggtcaattattagacctgctgagacagaacgatattatcagatcctgagacatgtccggttttgctatcacggacagtcaggtcacaggatccaatatgcgcaatagccagaacatttatctgtcacggtctgagaccgctgcccgcgaggaaaccacctggtcatttccgggggcgatcgttggctttgtgtcgtggttgttggcgctcggcataccctttctgctctatggcccgaatacactgttcttttttctgtatacctggcccttctttctggcgctgatgcccgtcgccgtggtggtgggcatcgccatgcactcattgctggacggcagactgctttacagcagcgtggcgacggtaattatcgtggtcaccatgttcggcgcgttatttatgtggctgatgggctaagccgttccatacttcaaagcgtaacgctcgttaaggcaatgtgtcagaaatgcgcacctgtgcgcccgcccgtaaatagtgctacatttggccgcgatgacgcggtatcggcttagtgtggagtctgcgcgcaagttatgggatgatgatgccgattttcagggggcacgatgggtaaattaacgctgctgttgctggcactgctggtctggctacagtattcactgtggttcggcaaaaacggcctgcatgacttcagccgtgtcaacgacgatgtggccgcgcagcagataacaaacgccaaacttaaagcgcgcaacgatcaacttttcgccgaaattgacgatctcaatggcggccaggaagcgattgaagagcgcgcacgtaacgaactcagtatgaccagaccaggcgaaaccttttaccgtctggtaccggatgcgtctaaacgcacgccagggtcactgcaaaataatcgataagcgaagcccgggtttacgacatggcagcaataattccggacgtttgtgccgtggtgccggccgccggatttggccgccgcatgcaaacggaatgtcctaagcagtatctctcagttggcaataaaacgatcctcgaacacgcggtggcggcgctgctggcgcatccgcgcgtggcaagggtgatcatcgccatcagccccggcgacgcgcgctttgcgcagctgccgctggcggatcatccgcaggtcaccgtcgttgacggcggggccgagcgggcagactccgtgctggcggggcttcaggccgcaggggatgcgccgtgggtgctggtgcacgacgccgcgcgcccctgtctgcatcaggacgatctcgcccgcctgctggcgctcagcgacaccagccgcgtcggcggtattcttgccgctccggtgcgcgacaccatgaagcgcggcgagcctggcatcgccgccgtggcgcataccgtggatcgtaacgatctctggcatgcgctgacgccgcaattcttcccgcgtgaactcctccatgactgcctgcaacgcgccttaaatgacggcgcgaccatcaccgacgaagcctcggcgctggagcattgcggctatcacccggtgctggtcagcggccgcgcggataacattaaagtcacgcgaccggaagatctggcgctggcagaattttacctcacccgaatgaccggaaaggagatggcataatgcgtattggacacggttttgacgtacacgcctttggcggcgaaggcccgattattattggcggcgtgcgcattcctttcgaaaaaggtctgctggcccactccgatggcgacgtggcgctgcatgcgctgacggatgcgctgctgggcgcggcggcgcttggcgacattggcaagctgttcccggataccgatccggcgtttaaaggcgccgacagccgcgagctgctgcgcgaagcctggcgtcgtattcaggcgaaaggctttacgctcggcaacgtcgacgtgaccattatcgcccaggcgccaaaaatgctgccgcatatcccgcagatgcgcgtgtttatcgccgaagatcttggctgtcatatggatgatgtgaacgttaaagccaccaccacggaaaagcttggctttaccggccgtggcgaaggtatcgcctgtgaagcggtggcgctgttagtcagggcggcaaaatgattgcgttcgacgacctgacgtttctgcatggcaaaccccaggcctccggcgcgctgaaagtcagcccggaagattttgtggtggtggaagatttaggttttgaacctgacggtgaaggcgagcacattctggtgcgcattcagaaaaccggctgtaatacccgtgcggtggccgacgatctggcgaaattcctgaaaattcccgcccgcgaagtgagcttcgccgggcaaaaagataagcacgcggtcaccgaacagtggctgtgcgcccgcgtgccgggcaacggtatgccggacatttccgccttccagccggaaggatgcagggtgctggaatatgcccgccacaagcgtaagctgcgcttaggcgcgctgcgcggcaaccagttcaggctggtgctgcgcgacatcagcgatcgcgcggaggtggagacgcgcctgcaaactatcgcgcagcagggcgtgccgaactatttcggcgcgcagcgctttggtctgggcggcagcaacctgcacggcgcgctgcgctgggcgcaaagcaatgcgccggtgcgcgatcgcaataaacgcagttttatgttgtcggcggcccgcagcgcgttgtttaatcagattgtcagcgagcggctgaaaaaaacagactttaatcaagttgttgacggcgatgcgctacaattagccgggcgcggaagctggtttgtcgccacccctgaagaacgcgcagatttacaggcccgcgtgaatcaacgcgagctgatgattacggctgccctgccggggagcggtgactggggaacgcagcgtgaagcgctggcgtttgagcaggcggcgattgccgatgcccccgaattacaatccttgctgttgcgtgaaaaggttgaggcggcgcggcgcgccatgctgctcaacgtgcagcagttaagctggaactggtgggatgacgtgaccgtcgagttacgtttctggctaccggcaggtagttttgccaccagtgtggtaagggaacttatcaacacatcgggtgattatgcgaatattgctgagtaacgatgacgggatccatgcgccaggcattcaggcgctggcgaaggccttgcgcgaatttgccgacgtacaggtcgtcgcgcccgatcgtaaccgcagtggcgcgtccaattcgctgaccctcgaatcttcattacgcaccttcacccatgaaaatggcgacatcgccgtgcagatgggtacgcctaccgactgcgtctatctgggggtcaatgccctcatgcgcccccgtccggatgttgtcgtctccggtattaacgccggggctaacctgggcgacgatgtgatttactccggtaccgtcgcggcggctatggaagggcgacatctcggctttccggcgctggcggtgtcgcttaatggttataagcattacgacacggccgcggcggtgacctgttcgatcctgcgggcattaaaccgggagccgctgcgcaccggacgtattctgaatatcaatgtcccggacctgccgcttgctgaaatcaaaggcattcgcgtcacgcgctgcggcacccgtcatccggcggataaagtgatcccgcaggaagatccgcgcggcaatatgctctactggatcggcccgccaggggagaaacacgacgccgggccggacaccgattttgccgctgtcgatgaaggctatgtgtcggtcacgccgctgcatgtcgatctcaccgcctacagcgcgcaggacgtggtgagcggatggctggagcgcgccggggtgaatacgcaatggtaacaaaacgcatacaggcgctgctggaacagttacgccagcaggggatccgtagcgagccggtgcttgacgcgctggcgcaggtgccgcgtgaaaaattcattgatgaggcgtttgaacacaaagcctgggaaaacgtcgccctgcctatcggccaggggcagaccatttcgcagccttatatggtggcgcgcatgaccgagctgctggaactgacgccggagtcgagggtgctggaaattggcacaggttcaggctatcagacggcgatcctcgcccatctggtgcaccatgtttgttccgtcgaacgtattaaaggcctgcaatggcaggcccgtcgtcgtcttaaacagctggatctacataatgtttccacccgtcacggcgatggctgggaagggtggcaggcacgtgcgcccttcgacgccattattgtgacggctgcaccgccggaaatccctgtggcgctgatgtcgcagctggatgagggcggcattctcgttttacctgtgggggacgaacaccagcaacttaaacgggttcgtcgacggggaagcgaatttatcatcgataccgtggaagccgtacgctttgttccacttgtgaaaggggaactggcctgattcctggaattgtctgagggatttcagcgcatatccgcgtagggtgtagctcatttgctaatgaccgccacggtcatcattaagtcactgacagttaacacattcctggaggataaatgagcacgggaagcccaaaatttaccgtaagtcgcctcgcggcattatcactggtttcgctctggcttgcaggatgctcaagctcggataacgcgccagcgccggtcagctccgtcggcggcaacagcgcttccagttcaggttccggaatgttaattacgccgccgcccaaaatgggcgcgtctgcgcaacaaacgccgcaaattcaacccgtccagacgcctgctattcagccgatgcctgcgcaatcccagacccagccaatggcagaacagccggttcagaccgaaaacggtcgtattgtgtacaaccgtaagtatgggaacattccgaaaggtagctataccggcggcagcacttatacggtcaaaaaaggtgacacgctgttttatatcgcctggatcaccgggaacgatttcagggatctggcccagcgaaacaacgttgccgccccgtatggcctgaatgtcgggcaggttctgcaggttggtaatgcatcgggtacgccgataacgggcggaaatgctatcactcaggctgatgcttctgcgcagggaatcgtcactccgcctgcacaaaattcaaccgtggtggttgcgccgaaaccgacaattacgtattctgaggactcaggtgaacaaagtgataacaagatgttgccaaacaacaagcctgcgactaccgtcacagcgcctgtaaccgtgccatctgctaccactaccgaaccgaccgccagcagtgcatctaccagcgcccctatatcgacctggcgctggccgactgaaggcaaagttatcgacaacttctctgccaccgagggtggtaataaaggggttgatatcgctggcagtaaagggcaggctattatcgcgaccgctgacggacgcgtggtatatgccggcaacgcactgcgcggttacggtaatttaatcatcattaaacataacgatgattacctgagtgcctacgcccataacgatacaatgctggtccgggaacaacaagaaatcagggcggggcagaagatagctaccatgggtagcaccggaaccagttcaacacgtttacattttgaaattcgttacaaggggaaatccgtcaacccgctgcgttatttgccgcagcgataatttggcagagtcattggctcactcttgtttcgtccctgcagcgcgcttaatcgccgttgcagggtaaaaaaacaaacagtgaagttaatgctttgtccagggatcacgggtaggagccaccttatgagtcagaatacgctgaaagttcatgatttaaatgaagacgcggaatttgatgagaacggagttgaggttttcgacgagaaagccttaaatgaagaggaacccagtgataacgacctggcagaagaggaactgttatcgcagggcgccacgcaacgtgtgctggacgcgactcagttataccttggagaaattggttactctccgctgttaactgctgaagaagaagtttatttcgcacgacgcgcactgcgtggggatatttcctcccgccgtcggatgattgaaagtaacctgcgtctggtggtgaaaatcgcccgtcgctacagcaatcgtggactggcgctgctggatctgattgaagagggtaacctcggcctgatccgcgcggtagagaaatttgaccctgaacgtgggttccgtttctccacttatgccacctggtggatccgtcagaccatcgaacgggcgatcatgaatcaaacccgtacgattcgactgccaatccacattgttaaagagttaaatgtctatctgcgtaccgctcgcgagttgtcccataagctggaccacgaaccgagtgcagaagaaattgcagaacagctcgataaacctgttgatgatgtcagccgtatgctgcgtctcaacgagcgcattacctcggtagacaccccgctgggtggcgattccgaaaaagcgctgctggacatcctggccgatgaaaaagaaaacggtccggaagacaccacgcaggacgatgacatgaaacaaagcatcgtcaaatggctgttcgaactgaacgccaaacagcgtgaagtgctggcgcgtcgtttcggtctgctgggttatgaagccgccacgctggaagatgttggccgtgaaattggactgacgcgtgaacgtgtccgccagattcaggtagaaggtctgcgtcgtctgcgtgaaatcctgcaagcgcaggggctgaacatcgaagcactgttccgcgaataatcgattctgtacaaaaaaggccagtcacatgactggcctttttctttgcccgctcctgagcaagcgggcggagcacacgccttagttcagcgtataatccagtgtgatttcagcgttgaacagctgagataccgggcatccggctttcgctttctggatgatcggatcaaactgatctttctcgatccccggcagtttcaccgtgctgttaagcgcaattttggtgattttaaagccgccatccacctgatccagcgacacatccgccgtggtgtcgatgctttccggcgtaaagcccgcttcgcccagcattagcgacagcgccattgagaaacagcctgcgtgggccgcgccaatcagctcttccgggttagtcccggctgcgccttcaaaacgagtattaaaaccgtaaggctgctgcttcagcgcgccgctttccgtggagatggtacctttaccgcgcttaatatcgccttcccagtgtgcctgccctttcttatgaatggtcatgtatttactccattttgttgctgaatgaagtaacaagtatagaagctcagccagggcttgcccggcaactcggaatactacgaagaggtgcagacacaacagggggaggttgtaggcccggcaagcctgcgccgccgggcggagggcgtcagaccagactcttcagacgatagatccactccagcgcctgacgcggcgtcagcgtatccggatcgagcgcctccagcgcttccaccgccgggctggtttcttccgcaggcatcagcagcgacatctgcgtaccgtccacctgggttgctgccgcgttcggggtaatgctctccagttcgcgcagcttctggcgcgcccgcttgatcacctctttcggcacgcccgccagcgccgctaccgccagaccatagctcttactggccgcgccgtcctgtacgctgtgcataaaggcgatggtgtcgccgtgctccagcgcgtccagatgcacattcgccacgccttccattttttccggtagctgtgtcagctcgaaatagtgcgtagcaaacagggtcagcgctttaatgcggttcgccagattttccgcacaggcccaggcgagggaaagaccgtcataggtcgacgtgccgcggccgatctcatccatcagcaccaggctgttctcggtggcgttatgcagaatattggcggtttcagtcatctccaccataaaggtcgaccgaccggaggccagatcgtccgccgcgcccacgcgggtaaagatacggtcgatgggaccaatctccactttttgcgccgggacgtagctgccgatataggccagcagggcgatcagcgccgtctggcgcatataggtgcttttaccgcccatattcgggccggtgatgatcagcatccggcgctgcggtgacagcgacagcgggttggcgatgaatggctcgttcagcacctgctcgaccaccggatgacgtccctcgacgatgcggatccccggtttatcgctgaaggtcggacagctgtaattgagcgtgtcagcgcgctcggcaaggttcaccagcacgtcgagttctgccagcgcggtggcgctctgttgcagatcccccagatgcggcatcagcagatcgaacagctcttcatacagctgtttttccagcgccagcgctttgccttttgaggtcagcaccttgtcttcatattccttcagttctggaatgatgtagcgttcggcgttctttaacgtctgacggcgtacgtaatgaatgggcgcaagatggctctggccgcggctgatctgaatgaagtagccgtgcacgccgttatagcccaccttcagcgtatccagcccgagtttttcacgctcgcgaatttccagtttatccagataatcggtcgcgccatccgccagtccgcgccactcatccagttcggcgttatagcccggcgcgatcacgccgccatcgcgcaccaggaccggcggcgcgtcaataattgcccgctccagcagttcacgcagttcgctgaactcgcccattttttcacgcagctgctgtaccggcttgcagtcgacgtccgccagctgctcgcgcaggatcggcaactgctggaaggcgtgacgcatacgcgccagatcgcgcgggcgggcagtgcgcagcgccagacgcgccagaatacgctccagatcgccaacctgacgcagcactggctgcaactcagcggtcagctcctgtaacgcgccaatggtctgctgacgttctgtcagcactgcggtatcacgcaccggcatatgcagccagcgcttgagcatacggctgcccatcggcgtgacggtgcagtccagcaccgacgccagcgtattttcaaagccaccggccaggttctgggtgatctccagattgcggcgcgtggcggcatccataatgatgctgtcctgctggcgatccatggtgatggagcggatatgcggcagcgaggtgcgctgggtatctttgacatactgcaacaggcagcccgctgcacagaggccgcgcggcgcgttttccacgccaaaacccaccagatcgcgggtgccgaactgtaaattcagctgctggcgggcggtgtcgatttcaaattcccatagcggacggcggcgcagaccgcggcggccttcaatcagcgaggtctccgcaaagtcttcggcgtagagcagctccgccggattggtgcgctgcagctctgccgccatggtctcccggtctgccggttcactgatgcgaaaacggccggaactgatgtccagcgtggcgtaaccgtagcctttgttgtcctgccagatggcggcgagcagattatcctgacgctcctgcaacagggcttcgtcgctgatggtgcccggcgtgacgatgcgcaccactttgcgctccaccgggcccttgctggtggccggatcgccgatctgttcgcaaatcgccaccgattcgccaaggctgaccagcttcgataaatagttttccaccgcgtgatgaggaatgcccgccatcgggattggctcgcctgccgatgcgccgcgtttggtaagcgaaatatccatcagctgtgacgcgcgtttggcatcgtcataaaacagctcatagaagtcgcccatacggtaaaacagcaaaatatccggatgctgcgccttgagcttcaggtactgctgcatcattggggtgtgggcgtcgaaattctctgatgtactcattggcgtatgatgtccatgttcttaacttttaatgaatgagtgagttttttatttttttacgtctcaccgcaacctgttcggtttataaggcatagcgagcatgataacggagtctgtagggcaggaaaacaacaggggaaggctttacccgtttaagtgcgccagaaggtatgcagacaggctgcggtatgacgttatgggtaatacttgatatactattagtcttacatgtgactgacaggagacgctatgcgaaacaatcaaaaaggtcagcaaggctataccagcccttcacgcgctgacattgcgcgcgctgttgtgacctcaacagcggttgaaaccggtcagccttcagccaaagttgaagcttcgcttgaagcggcgcgtaaaaaattcgcccatcttcgtcttgcctaatcctttcttaacgcctggctcacccagtatttcatcggttcgtaattcatcaccatgcccgcatgaatagctgagatgtaccgggttttgttctgctcccagcgttgatagtccagcggcttatagcccccctgaaccgccatcacatcggctaaaagtcgtgataatcgcccatttccttctctgaaagggtggacgagtatgagttccacatgtgtgattgcgatagcttcaatcagctgctcttcgctcataccagtacagggtgtgtaacgggcaaggtatttcacatcaaaatccttcagcagtttgggcagctgtgctgaaggagcaaacataaagccgcctttactgatattgaccgtcctttcttgccccgcccacgcataaatattgcctaaccagcgtcggtgccagctttttaggatctcaactgtgatcaaccccagcggaaaatgctgttcaaagacagcgtgatagagttgctcgaggagtaccagttctgcgtcatcaatgtcatgagcatcactaatcccgagcttattcgccaaaatttgttcgccagagcctttctcaaactggccttcgctattggttacatggtatcggctcattgcaataccctggtttataaggcacagcgagcatgataacggagtctgtagggcaggaaaacaacaggggaaggctttcgtttaaagggacatcgcgcaggatgaaaagccgctatgctgccagtcggtttcagagcctgcgcgtatcattaaagatgcatcagcggcgttcacgcagcgcggcgatatcctctggcgtcgtgcggcagcatccgccaatcagtttcgccccggcctctaaccactgtgacacatgtcccgccagggatccgcagctgtcgccatgcgtatgccaggccttgcttaccgcgtcataggtttcaccggaattaggataaaccaccagtggcaacgcgctcaggctttgcaggtgcttcagcgcggcggtggttttattcagcgcgatacagttaatccccagcgcaataacttgtggataggcggcaagcgtattcaccacctgagcgagcggtgtgccatcgctcagatgctggtcatcccttaaggtaaaggagaaccacgcccgtgcctgcgggtactctgtcagcaggtcagccagcgctgtgatctcggcaaaagagggtaaggtttcacaggccagcagatcggccccggcattgagcagggcttcaatgcgcgggcgatgaaaggccttaaattcttccgcagggcgtacataatcgccgcgatattcagagccatcggccagataagcgccgtatggcccgacggatcccgccaccagcagcggacccgcggctggattttcacgcagatagatttcccgcgcttctttcgccagcgcaacgctctgttcaatcagcgctgccgattgtgcctccgtcagtccacgtgccgaaaagcccagaggcgtggcctggtaactggcggtaatggcgatttgcgcgcccgcgcggaaatagtccagatgcacgtcccggataagctgcggattttccattaacacttttgcggaccagagattatccgcaaggttgcatccgcgcgcttccagttcggtggccagcgcgccatcaagtacggcaaagggatgactttcaagcagagcggtaaggggattaatctgcggcatagtcagtctccttcgatgtggttttatgagtcagaaaatagctggcatagcagagggcaacgaaaggtatgccgcaccagagcgcaatgcgctgatcgggatcgaacgccaggccgatacaggcgagcagacacagcaggaagccgagcaccggcaccaggggataccagggcgcccggtattgcaacccggcgagcggcttacccgaccggatgtggcggcgacgaaatacaaaatgagaggcgcagatgctgagccagacggctaccacggcaaagccagatatggcgctgagcgcaacaaataccgtatcaggggcgatcacgctggataacagcgccagcaggccgccgatcatagaagcggaaagcgccaccagcggcacgccgtttttattaacgcgggcaaaacagcccggcaaggttttttcattggacagcgaccacagcatgcggcccgatgcatagagaccggaattcgccgcagaaagaatcgccgtcaggatgacaaagttgaaaatatccgccgcatacggaatgccaattttttcaaagaccagcacaaaggggcttttctcaacgcccgcgacttccatggggatcagcgctgcgagaacaaagaccgtaccgataaaaaacacaatcaaccgggcgatagtggcccggatcgccaccgggatcgcctgatgcggattttccgtttcccctgccgctatgcctataagctccgtgccggaaaacgcgaaattcaccgccaccatggtcatcagaatgggcagaccgccgtgggggaaccagccctcgcgggtgagattaaccagcccaggcgcggaggatccatccttcatcgggataaaaccgaagatcgccccgcagcccaggataataaagacgagaatagtcgcgactttaatcagggagaaccagaattccccttcggcaaaaaagcgcgttgagaccgcgttaagggaaaaaatcagcacgcaaaacagggcgctccatatccagacagggacgtgtggaaaccagtactgcatacagaatccggcggcggtgaagctcgatcccagcgccactgtccaggtaagccagtataaccatgccacggtgtagccggttgccgggccaatatagcgcgccgcataaacatggaaagcgcctgtcacgggcatcgccacggaaagctccccgaggcactgcatcaccagccagactaccagcgcgccaatcaggtaagccagcagcgtccctgccgcgcctgtggtggaaatgatgtagcccgtgttaaaaaacagccctgtgccaatgacgccgcccagggaaagcatgatcaaatgccggggtttcatggtgcgcttaagctcgccattttcttgttgcctttgcatatcaccttctaaacgtatggatgtctgaatgtccgtatggcgttctttatagcctgattgttaacaaaagaccagcccggggcatgggggagcgcgcgccagtggtcaccgggtgccggatgcagaaatttttcagggtaaaggttaataattattaaaacgccataaatattggtcgcgtgttttaacaccgttatgaattgattaatctcacaattaaaatttccatgatagatatttattattttaacgaagtttttattagcactttcttgtgcaaattatttcgttgattagcagacgaactaaaattaattacagccaggattaatcttataagtacccttaaacatttatctttctgcccgtttgctaattaggctctattcttataaagcagcgcaatctcttaataaaactctctttaatgctaaagaaaccgagcggttccccggaataatttatcaattttatttttcattcacgtcccgtgtgcgcatgaaaagtatcattgcggagacgttgctatgcaggtgttcagatcgttctggcaggcggggtatgagggtgccgatcatatcacccgaaataatgatgcgctttcaatgaataacgccacagcccatgataaaaagcatcggcaggattatcaggcgctcgcgccatttcaaattaccaccgtcagggaaagcgtcggctggcggctggtggaacaggaaaatggctacgacttttcttccgttgctgaaaaaatggcagcagcgcaggacaacggcattcagatttgctggaccatttgtcattacggctggccggaaaatattgaattcttttccgaagattttatttcgcgcttcgctcagctgtgcggagcgctggctacattcctgcgcccgtattatgacgaggcgccagtttattcgccgatcaatgaaatgtcttttaccagctgggggatatcggtcggactatttgcgccttctctcagcgtgcgcgatccgaccggtattcgcagcaaacgtcaacttgttcgcgccacgcttgccgcctgcgatgccatctggcaggcggatccccgggcgcgatttttacactgcgatcccattattcatctggtatcgccggacgacagccccgaatcgcagcagaacgcggcaggctggcacaacgcgcagtttcaggcctgggatatgctcgccgggcgtctggagccggaactgggcggcgcgccgcgttatctggatctgattggcgcgaattactaccacgacaaccagtgggaaagcgaaaccaaccgccgtctctggtggcatctgggcgacagtcggcgcaaaaggctgcacagcctgctggcagaactttatcagcgttacgagcgccccctcctgctggctgaaaccagccatgtgggcagcgggcggggtgcctggatcacggagattgcccgggaagtcgcccaggcgcagatcgcgggcgtggagatgatggggatctgtctttatcccgtcattgaccggccggactgggaaaaccacgccgtctggcatcgcagcggcttatggaatatcgaccccgaaggacatgacccttttgaacgtcagctcgatccggtctatgcgcaggcgctcaaccgcgcccggcagatgctcgatcatttccagtgtttatttagcgtggcgcacagggcctgcaaagagagaaaacctatgaaaagaatctatgtttttagccatctgcgctgggattttgtatttcagcgcccgcagcatttgatgacccgtctggctgagcactattcgatattttttatcgaagagccggtattttccgccgatgaaccggcgctttacctgagccagcccgcgcctaatgtgaccgtcgtgaagccgcatacgccatcgccggttaccggttttcatgacgggcagatcgagtatatgcagtcgttgctggcggaaattaccgaagacgacgaaacgcccatcgtctggttttataccccgatggcgctgccgctgctgaaagtcttctcgcccgcgctggtggtttacgactgcatggatgagctggccgccttcgaaaaagcgccgcgtcagctgctgcaacgtgaatccgcgctgctctcacgggcggatattgttttcaccggcgggccaagcctgtatgcagcgaaagccgggcggcatcacaacgtgcactgcttcaccagcagcgtcgatgcggtgcattttgaacaggcgctggatcgcgctaaccatcatcctttacaggacgatattccccatccacgtttgggattttgcggcgtgattgatgagcgtatggatctggacattatcagcgcgctggcggacgcgcatcccgactggcaactggtaatggtcgggccggtggtgaaaatcgatccggcttcgctgccgcagcgacaaaatatccattatctcggcatgcagccctatcaggcgctgccgcagttcctggcgggatgggatgtgtgtctgatgccttttgcgctcaatgccgcgacgcagtttatcagccccaccaaagtgctggagtatatggcggcgcagttgccggtggtcagcacgcccattaccgacgtggaaaaaccatatggccacgtggtggcgattgcccgtacgcccgcagagtacgttcgcgcctgtgaagcggcgctgcagatgagtgacgcggcccgccaaaatcagcagcaggcgatgcagggcattgtggcggcgacttcatgggatcacactgccgaaaaaatgcatacgctgatggataatctgctgcacagcacgccgccggaaaatgtgctcagcgccgcaacggacatggcggagatcaacgacccttcggtattacgcctgacgccgccgcaccatgcgccggcagtgtccacccgctgtctgattctgggagccggaccgacagggctgagcgccgcctttcattatggcgaaggcgcgaccctgctggagcgcaatgccaccgttggcggcctgtgccgatccatcgaggacaaaggattcaccttcgattacgccggacacattatgttttccgaagacagctacgtgaaagcgctgtacgacatgctgcttggcagtaaccttcactggcaggcgcgagaggcctgggtctacaccgagggcgtctatacccgctatcctttccagggcgcgctctacggcctgccgcccaatatcatcaaagagtgtattctcggcgcgatagaggcgcgttatggcgtggcatccgcggcgaaaaccgtgtcgatccgtagcgataaagaggcctcctgtgacagcagcgccggtcaggtggtggactgctgcgcggatggcagcatcccggatctgagcagcaatgacagcgtgcaggacgccatgccgccggacaattttgaaagcttcatctataaaacctggggcgcgggcatcgccaggcacttcgccattccgtacaacaaaaaattgtgggcggtgccgctcgccgagatggaaacctcctggctgggcggacgcgtaccgctgccggatctggcacagatcattgaaggcgcgctgaccgaaaagggcaaaccgatggggccgaacgctttcttcggctatccgctgaaaggcggcttccaggcgctgatgacggcatttttaccctatattaaaggtacggtggaaaccggggcggaagtgaagcagatctttgcccagcagcatctggcggtgctggcggacggcagacagtatcgttacgaacagctgatcagcaccatgccgctgccgcagcttatccatattatgggcgatgaagtgccgtcatcggtacgggcggcggcaaatggcctgcgccatgtgtcggtgcgctgcgtcaatctgggaataggccgggcgaatttaaccgataaacactggatctattttgcgggcagaaccgtcttccaccgtatttttgttcagggcaacgccagcccacactgtaatccggaaaatggcttcgggctgacctgcgagatcacctattcaccggacaagccgctgccggagcagggacaggcgctgatcgacagatgcatccgggaatgtattgaagtggggatctttaccgctgacgatcccgtgctgaccgcaagccaggtcgatattccctgcgcgtatgtgctttacgatcatcagcgtaaagcaaatgttgaaacggtcagaaaatggctgttatcccgtgacatcattctgtccggacgctacagcgaatgggaatattacaattccgatcatgcttttattgccggtaaagttgccgcggaaaaagtgaaaaacgacgaatatcgtcattcaggtttatagtctgtgttaacaccgggcaggtatctgcccggtgaatatagtcaatgttattaatctattacccgcctgcatttccccgccttttcagatttcatcaagagatatcaattacctgtttatttaagatgtgtcgctaactgacaggggcgattgttttttaaacatattaccggtcagtcacactatttcatggaatacgcccatcaggaagatgagcgttaaaaggaagacgacaatgaaacgacacccactattatatttattaggcacctcgctgttattgggcgccagccaggtcagcgccgcggataatagcctttttatcaaaagcaaattactgaaatcctccagcgaaacccgcgccatcgccgcggatcctgcaacggcctcggttgaggttatcggcattaacagcaacattattgccgactccacgccttttctgacggtgctgctgccgggccagacgaaggaagaaaaggtctggttagccagcttcagcaaaaccgatcgtgggatgcaggtctggcgcggccgctataaccgcaaaatgctgaaaaataccgccatgaagtcactgaaggcggctgactttgattcggtgatcctggtacgcaaaggcgataaggtcaccggcaccgtgcgtcgcaacggacagctgtaccgcatccagccgctgagcagcggccagcatgcggtgatcaaaatcaacgaagccgccgtaccttacgacacagaacatctggaaacggtgatttctgatgtcacctacgaagaaagcgacgcgcctgatttatcccgcctgggttatacgctgccgtgccagtcatcctggggggccgatactacctatccggaaaaaggctggatggtgagctacaacgagcgtaactaccgcagccgctgggaaaccaaaggcgaaatgccgggcgtatcgccagtatgggagccaaacggcgtatgtattcagattggcgaagccccggcgccactaccattacctgtacccgtgcaggtctgtgcggcggaatgggcggcgcagaacagctatccgcaggcggatctgttggtgagctaccagggcatcaactatcgcagccgtaataaggtggcggcggatgatgtgccgggcgttaacccggtgtgggagccgcagggcacctgctatgtgcccgcagtgccgcagcctgaaaagtccacggtgagcgtgctggttgctgccacaccggcggcggcgaaaagcctgggcgatctggacgcggtggcgcagctggcggtggaagaaacgaacgaaggctatgaaaacagcggtatcgatctgaaactggtgctggcagggaccatgatcgatccgtcctatgtagagcctgcgaattcatccgacatgctgcgcgatctgaaaaacaccaatgacaacaagctggaagaagtgcactaccagcgcggcctgaccaatgccaatattgcggttctgctggcgaagaagtacggtttctgcggccaggcctatgtaaacgccagggcgtcaaccgcctttgcggtggtggaggcttcctgcgcggtgggcggttacagcttcggtcatgaaattggccatttgctgggggcggcgcataacaaatccagcgccaacgcttatgcctacagctatggtttcggctggcaggatccggaattcctgttccgtaccatcatgtcctatggctgcgccaaatcctgcccgcgcatcaactattactctcatgccactatggagtacaacggtaaaccgatgggcaatgcgactgaagcagacaacacccgtgtgctgaaagagcgtaaggaaacggctaccacctggcattaatcctgtcgcgctctgcgatatatcgtatttaatcagaaggcgggcataatggcccgcctcttttttttgtaagattattaaatataaataaatatattcttactctgccgcttcgttatattccatgtctcgctttaagataattccaggcactcctggcacaattaatataatggcttttatatttgcatcttcgctggcagacgctatagttaatattgcctgacggggaaatacttcccctgatttaccaaaactcaatgaggtattaattatgactcagcaacgtggcggttccggtaatttctcacaagatcgcgaacgcgcatccgaagcagggaaaaaaggcggccaacaaagcggcggcaactttaagaatgaccctgaaagagcctcagaagcgggtaaaaaaggcggtaaaaacagccatggcggcggacgttcttcctgatccgtcaatgcgctaaccggtgttctttcatttgctgacgtgaatgatgacgttaaaaattaaagaaccggtactggcaatcctgcacttacgtgtggggttgccattttgtttttcaggaaatgataaataaaaagtgctatcaggattttaattcttccagcagcagaatagtgccggccatggcgtaattcgccgcctgcaataatactgcctcactgtccccttcaaattgtttacactgggtataggtttctgaccctggtaattgccatgcaaaccagatagttcccgcgggcgtgccgtcttcgccaccatcaggcccggcgtaaccgctgaccgcaattgccacgtccgcgccagaatgagcaatagcaccggccgtcatctcaatcactgtctgctgacttacggcagtgtgcatctcaatggttttcttcttaacgccgagagtggtgatttttgcttcatccgtaaaagtgacaaaaccgctgccataaaaagagggggtgtcttttgccgcacacaatgcagaggcaatttgtccgccggtacaggactcagcagtggtcaaaaagagttttttttccgtcagtaagcgacctaattcattggcaatagacgccgaaggcattgtcataacaaactccttaactgcgcgagcccggaataagatccgggctcgctcagaatgcattgaaaaaattaaacgtcttttttcgctgcggtattttcaatcggctctgcaacggatcccaggtcagtgccggtgaccggattgatagctgggtcggactgcgtgcgcttgatcatcgccagcaaatcactttcctgctgcggaggcagcgtcacagaggctttaccgtcgccgccgtcaacagctggctgcggatcggcaacatagttgaagttctcgtcgctgttccagctgccacgaacttcttccccttcagacatattgaagtaggtgttggcatactgctcaattggcggcaatttacccggcgggaaattgttgcgaatagagtacagggctttttcgaaagacatctggtgcgccacttcgcgcgtcatcaaaaagcccagcgcatctttcacgcccggatcgtccgtcaggttaataaggcgttcatagatgattttcgcacgtgcttcagcagcgatgttagaacgcagatccgcggtcggttcgccgatggtatcgatataagctgcggtccagggcacgcccccggagttcgtcagcggcgtaccgccgccgtacagcagagaggtgatatggctgtcgttgccgcggccggtcagcgagcgataaagctctgcttctttttcagtcccttccgctagttcacctttggcacccttgttcagcatgccgaccagcgtaccgatgatttcgaggtggctcagctcttcggtggcgatatccagcagcatatctttgcgtcccggatcgtcgtcactcaggccctgggtaaagtagcggcaggcagcagccagttcgccctgcgggccgccaaactgctcaagtaaaaggttagcgaggcctggattaggctccgctacacgaacggtgtactgtaattgcttcacatgtctgaacataatttcctctgttttatcatcatcgcccgaaggcgtggtctgcgccggttctcagtggaaagattactttttagcttcggtgtccggtgtcgccgaacggatcaggaactgctcggtgacgtctggaatatgggtgatgcaccattccgccatcgctttttcctgctccagaatttgtgcaaatacgcgtgcgccttcttcatcaccggccattttcgccgcagcgatcagggaggtgtaacaggcaatttcgaagtgctcaaacacataaccgctgatggcgccttttaccacttcatcaggcgtcatcatgccgccaacggcctggcccagcgccgccattttgctcatggcatcttttacgattgaggtggaaacaccattgcgttcgatcacctgatcaagcaggacttgttgctgacgggtttcttcaatgtgctgcacaatgcgggctttcagatcggggtaatgctccaggcggtctgccattttggacaacattgactcagcttgtttttccatcgcatgagcatcacgtaaccagtcatgataattttccagatgagtcatattaatttctcctgatagaacattgttgtaggcaatatatgtggcggaaaagttgctatcatcacaatgataattccccccccacatttttgtttaccggacacaatggaaacagcgaaacatcatcattattatgtttcaatgttttcattgttttactttctgatagttaagcgtagcacaggcttcgggttgcgctaatttaatgcaaatttttttgtaaatcagtggctcatgcgcaggtattagtttttgaccggaatcaagaagttcagtctgcataatatattttacattttatttttacgtttattagttcagcttcgttttttgtacataagacaaatcctgaacgtttgctgaaatttttcgggcaagtgtcacttgacagtgtttaatatgagtccagacttaaagagtcttttttgaaaataaaagactggaattaataatattcctgagtttatttgcgcttcgttattgatgcgtatttagtagcctgaacatatgtaataaaggagggcacgatgaaatatatgatgaaccctatggctggtcaaaaagacgatccatctgaagcgccggaatccggcgacaaaactgatgccgatccgaaaaagtaatgccagtccgctgatataaccagtcagcggcagactctggcaacggaaggggaaaaaccaacgcttagcggcgtctgtttttccccttttgcttatctggcgacagacgtcaatggcggcgtattatccagctgacgaatggaaggagtgaagcagacggcgatggtcgccgtcacaatggccacggctgacgccagcagcacattactgctgccatagtgtgccgccagtggccccgcagccagttcgcctgccgggatagccacaaaggagccgagcgcatcataagcgtacacgcgggccagcttatcaggtgggatatgcgtttgcagcgactgcgcccaggacacgccgaataatccgaatcctgcgcctgccataaaaaaggccgccatcaacagcgcgggcgaaggtaacaggctgagcaaggctaccggcagggcgcagaggttgaccagtatgacgccgataaacagatcccggcggggccgccagcgaagcgcgataagcgatcctgagatcaggccgaggctttgcgcggcaataataaatccccagtttgcgcggccgaaggtggcgtcggcgactaccggacccagcaccattacgataccgctgaacgccgcgttgacgatggcgaactgcgcgacaatcgcccaaacccatgaacgggcgatgaactctttccagccgtcgcgcaggtcctgcaaaatatgggacgccgggccgtcagacgcgtgcgcgacggcgcgggtcaacagatacagcggcgcggcggcggcaaagcccagcgcatccaccgccagtccccagccagggccaatggcgctgatcaggatcccgcccagcgaagcgccgataacggtgccgccgtaaattcccagttgaataaaagcgttggcttcgcgcagcgtcggcgagggcaccgtttgcggtaccatcgcggaagaggccggaagcgcaatgcccgccgctgcgccgttgatggcgcccagcaccgtcagcagggtaaaggtcgccgcgccatccagcactgaccatgccaccaggccctgcgacagcgcagcgatgatggatgatgacaccagcaccatactgcgggagtaacgatctgccagtacgccgccaatcagcagaaaggcgacgttaaaaatcgaacgcgccgccacgacgatcccaagctcggtagcgctgccgcccatatccagcaccgcgaacgccagcgcaataggcgcgatgccgttacctaatacggtaaacaagcgggcaaaaaacaaatggcgaaacggcgcataagaaaaggcccgtcgggttcgcggcgcgtggttatctgacgtcatgggatgtccccggtggcgttaacctgcccaatccaggtcgtaaagcgggctatacccatgctgatttcctctcccttgcaggtaatttacccggtgatataccggataaaggggcattacactactccgtgcacgggcggatgatcaactgcccgaattcgaccacaaccgagaccgcggccccggtgggaaagcccgcttcggcgagccagtcgccctgtaaggacaaactcgggtgcaggctgtaacgcctggggattttggttttgcgctcttcatgacgtctgcgcacataccccaccgtgatacggcgcatcgctttagacatttttacctctgaaactactggcttcccggtcatacaccactccttttccacttatcggttgttgaacataccgtcataaattgctgtataaattaacagtaaaataccggaaggcaaggtgaggaattgcgaggcggattccagaaatgcaatgcaaaaacagcaacgcgtttcattcacgtaagaatatattgtgcaataagcttttccttattttcctcatgcgaaagtgttagtggatttgtatatatgtcttatattaataagactatttatgagggacgccgatgaacatacccgcactgcccgccaatgaaactgaacgtcttaaatctctctatatgatggatttgctggacagaaaagatgatgagcgattatcacgcttaacccgtgtggcaaaggcgaccttcaatgtgcctattgcgctgatctctctgctggatcgcgacaggcagtggctgatctcgccgattaatgagaatttacggcagacctcgcgtaatgtttccttctgcgcccatgccattttgttgcaggggattttgatcgtcaaagatgcccataaggatgagcgcttcgcgaagaatccttacgtcacaggcgcgccttttgtgcgcttttatgccgggtgcccggtacatttgcccgacggttccattgccggcaccatctgcattattgactcaaaaccccgtgatttcagttccgatgaaattaatttactgctcgacctgggggcagtagtggaagatgaatttttgatcatcagccaggcgatgactgacaagctgaccgatctgcctaatcgtcgtggtttttatcgccttggcgacaaacgttttaaagagatgaccagcacacagacgccgttcagcttgctttatttcgtggtagacaacttacagtcaattaatgacatctgggggcatgccgagggcgataatgtactgcgcgggtttgcccgcagtcttggcagttgtctgcataaagatgatatttgtgggcgggtggatggtagcgcctttgcggtattgctacagcagaaaaacgatcacgacgccgatgcgtttctgtttaaactgcaaaccaaaatcgatgagttaaatcttaatgcggataacaaatatcacatcaactatgcctatggcctgctgcaaagcgatgcggaaaaatacactgatataattgaaatgctcaatgacagcgatacggtgatgtattccgaacatcgcaagaaaaagcacagataagcgccagacttaacgccagcgcgtgcgctcaatgccgcttttttgaggcttaccgatgggcatttcatctgcccatttggtggcatcgttaatcatttcggcgacaataccccgcgtcagcccgacctttttcgcttccaggctggcttcttcccactggcggttttcatacagctgcgccagattcaccagctgaaaaagcatgcctttgcgttcctgtaacgcaatgcgcacgtcggcggagatcaccacctgttcgatcagttcttcctgaggaacaccgagaatgacatccagcagggaaaacaggccgaccataaaagcatcgtttgaagagtggatgccgagtagccggttggcggcgagttcgcagaaacgggcgcggatcaggcttaaataataaatttcgttagttttggcgctgctgaacgacgtcagacaggcgaccagcacaaaacggcgcagctcggtgacgccaagataaaccacaatgtctttaattgactggctgcggctgccgcgaatgccgcgcgcattgtataaaatattctgcgcataacgcataattttgaacgagagcgcgatatcacgcttgagcaattcctcaatctgcatgagatccggggattctgcgttaacttcctgaataagctttagcgcaatgatctgattctgaataatttttttacttttgaagattaccggcttgctaaaaaaatgtccctgaaacagggtgaagcccatatttttgcaggtgtcgaattcttcgatggtttccactttctccgcgaggaaaatcgtcccgttgagcaacgcacggtggtgcagaatataagcctgaatttcctgtaaggtactttcgcgcacatcaaatttaataatgtggacatagggcagaaaagcattccagttatcgctgagcgaaaaatcatccagcgcaatacgaaagccttttttatgcagttgcttaacggtttccagcagacgcggatccggctgtgcggtttccagaatttcgacaactacccgatctttgggcaaggtttctgccagccctttaatcagcagttcatagggaaagttaacaaataccgcgctggcagcgctctgacggtcggttggtacaccgagaaattgttcttcaataagctgagcagtcgcttgttcaggcgagacattgggaaactggttagtcatgctatctctgaagagcagctcatacccgaaagtattgagattttcatcaaaaattgcctgccttgcgacaaaagaaaacattctccatcctcacccggaaccatcagctggtcgctgaaaaaagccgcaaccaatttaagtttaagacaggagccattttgctgcctgctggcgtgatttgtaaagtttagtcacagtaagttgatggttttttatcgttttaaaacaataaattgacattaataacgtttttaccctacctgggggcgtctgacgcccccaggcgggcgcttaatttatggctgtcgcccggcgatcccgccagcctgcgaccagaaaggcgaggataaataccgcagtgaaaagcacgacaatggttggcgcgggggcgctgtcgagccagaaagagagatagaccccggcaaaagagaccaccacggccagtatcaccgccagccacaaggcatgggcgaaacggcgcgtcagcagcaccgcgaccgcaccgggggcgatgagcagcgaaattgacagaataattcctaccgattttaaggtggcgactatcgtcagggcgatcatgcacagcaggccataatggagcagggcggtgttcagaccgcaggcttttgcctgctgcgcatcaaaggcatgcagtaaaaaatccttccattttaccagcatcaccagcgccactccggcggctatcaggctgctttgcaggatgtcgcttgttgccacgcccagcatatcgccaaataaaatatggtcgagatgcacttccgactggatggagatatagaggatcagtcctgcgccaaacatgccggaaaagacaatgcccatcagcgtatcgcgcttaatgcggctgttatcgtcgagatagccggtagcgatggcgcagaacagtccggcgataaaggcacctatggcgacggggataccgatgatccaggcgatcaccacgccgggaaagacggcgtggctcatggcgtcacccatcagcgcccagcctttcagcaccagaaataccgacagcagggcgcagggcacggcgacaatcaccgaaatcgccagcgcgtttaccataaaatcaaactggaagggttcgaacattatgccgcctcctgatttgccagccgcgcccggcggcggttcgccagcagaccatgtttaggcgcaaacacaaaggccagcaggaacagcagcgtttgcgccaccacgatgatgccgccggttgcgccgtccaggtaatagctgacccaggcaccgagaaagctggtgatactgccaatcgccaccgcaatcgccagcaggcgggggaagcggtcagtgagcagccaggcggtcgcgcccggcgtcaccaccagacagatcaccagaaaggccccgacggtttgcagcgcggcgacggtggacaccgacagcagcgtaaagaacagtagcttcagacgcgccgggttgaggccaatggagcgggcatggttctcatcaaaaaaggtcaccatcaggtctttccatttcagaaacagaatgaccagcgagacgatgccgataatggcgagctgaatgacgtcttccggcgcgatggccagaatattgcccagcacgatggtctgaatatttacggacgtgggattgagcgacaccataaacaggccaatgccgaaaaaggatgaaaaaatcaggccgataatggcatcttctttcaggcgcgagcgctgattaagaaacagcatcgcgcccgccgccagccccccggataagaacgcgccgagggagaagggcagaccgagcatataagcgcccgctacgcccggcacaatggagtgagacagcgcgtcgccgatcaacgaccagcctttaagcatcagatagcaggataaaaacgcgcacacgccgcccaccagcgccgatacccacatggcgttaagcatgtattcgtaaccgaacggctccaggatccagttcacggctgctctccttttgcaggcggacggcgggaaataaaggggcgctcgtcatcggtgatgatgtgctcctcactgccgcttaacaccacgtgacgcagcacgccgctgaacgcctgttcaaggttttctgcggtaaaggtggtttccgtcggcccgctcgccagcaccgtgcctttgaccatcactgtgtaatcacagaactctgtgaccgagcctaaattgtgcgtcgataccagcatagtgcgcccctcgtcgcgcagttcgcgcagcagttcgatgatcttcgcttcggtctgtacatcgacaccggtgaatggctcatccagcaaaatgacctgcccgtcctgggcgatggcgcgggcaagaaacacgcgctttttctgcccgccggatagctcgccgatctgccggtgacgaaattccagcatccccacgcgggcaagggcggcgtccacagcctgatgatccggcgctttcgcccggcgcagcattcccatatgcccgtaacggcccatcatcaccacatcttccaccagtaccggaaacgaccagtccacctcctcggcctgcgggacgtaagacaccagattttcacgcagcgcctgtttaacaggccgctgaaggatggaaatctcaccgcccgccagccgcacaaagcccatcagtgccttgaacagcgtggatttacccgagccgttgatgcccaccagcgcggcaatggaaccccgcggcacgctaaaactggcgtcacgcagcgcggtatggccgttgcgataggtgacggtaacgtgctgaatatggaggcctggcgactgggtttgcgctgaggtattcatttttgcgcctccacgccctgctgaatgcctttcaccagggtttcactggttacgcgcagcagatcgagaaaggtcggcaccgggccgccggcggcgctgagggagtcaacgtagagtacgccgccgtagagcgcgccggtttcccgcgccacctgtttcgccggtttatccgataccgtactttcgctgaacaccaccggaatatgatttttcttgatcgcgtcgatcactttgcgcacttgttgcggtgtgccctgctgatcggcattgatcggccacaggtacagctctttgagatcataatcccgcgccagataggagaacgccccctcgctggtcaccagccagcgtttgtccgcaggcagtgagtccagctgcgcgcgcaccggagccagcgttgcctggatcttcgctttataggctgtcgcgttttgctggtagatttgtgcgttgtccggatcgtatttcaccagcgcatcacgaatgttatccacgtagatcagcgcattttcggcagacatccatgcatgaggattaggtttaccgttataggggccttcgctgatgcccatcggttttacaccatcagataccaccacctccggcacgccggacagatgctgataaaaacgcgcaaaccacagctccaggttcagaccattggcgaggatcaactgcgcgccctgggcgcgtttaatgtcgccgggcgtcggctgatattcgtggatctccgcccccggtttggtgatcgaactgacctctgccgcatcccccgccacgttttgcgccatatctgcgatcacggtgaaagtggtgatgaccctgaatttctcttttgcctgcgcgggcgaaagggcgaacagcgaaaccagggcagcggcgaacacgaatctcagacgtgatgagtacggcatggtatccctcatgatggcgtggttaataatacagcgaatatagcctttgctatgttatatagcacacgctataggtctgagcgaaaattattcgcatttaatagccaggcagacaaaaaatcaccgatctggtggcagggaatgtaaagttgtaaaataaaagcatgtttatattcaggagcgcgttcctatgtccggcaaacgcattgcccgcgaaaaactcaccatccgtaaaatgatcacgctctatcagcggcagtcacccgatgccgttgccgatgcggagcattacgacgcgctgtacgcctatgcggaaaaacggctggataaatgcgtgtttggcgaggaaaagccggcgtgcaaacagtgcccggtgcactgctatcagccggtaaagcgtgaagagatgaaggcgatcatgcgctgggcggggccgcggatgctgtggcggcacccggtgctgacggtgcgccatctgatcgatgataagcgcccggtgccggaactgccggaaaaataccgtcccaaaaaatagcccgacctttattccgccgggccatccgtttagtgcagcgtatctttatcaatccccagccgcttcatccttgagagcagcgtcgtgcgttttaaccccagccgctgcgccgcgccttttggcccggcgaccacgccgttggtttcacgcaggatcctgacgatcaactgatattcatcttcgccctcctgcggcgtttccaccgccgcatcgaagcgttgcggcacgctcatttccgccatcgacaattgcagaacgttgccccgcgtcagcagcacggcgcgctcgacaacgttttccagctcgcgcacattacccggccacggctggttgcttaaaatacgcagcgtttcggcggggatgctgtcgatattgcgccccagccggtgggcgattttgaaggtgaaggctttgaccagcaggggaatatcttccgggcgttcacgcagcggcggaatgcggatcggaaagacgttcaggcgatagtagagatcgctgcgaaattcgcgatcggccaccatctgtttcagatcgcgattggtggcggcgatcaggcgcacatccgtctggatcagtttgttgctgccgaggcgttcaaactcctgctcctgcaatacccgcagcagcttcggctgaagttcgagcggcatatcacccacttcatccaggaagagcgaacttttatccgccagttcaaagcggccgatgcgctgggcgctggccccggtaaaagctccgcgctcatgaccaaagagatcgctttccagcagtccggcaggcatggcggcgcagttcattttcaccatgcggcgcgcgttgcgtccgctgagattatgaatagcgcgggcaatcagttctttcccggtgccggtttcgccaaggatgagcaccgtactgttgcttttcgccaccatttccacctgttgcagcacgctgtacatggcttcgctgcggccgataatctccccgaactcgctgtccacgttgttaagctgctcggtgagcgccaggttttcatccaccagccgttctttcaggcggtgaatttcctgataggcctgcgcattgtcgacggcaatggccacccgttcagcgatctgccgcaacagcgacagggtggacggcgtaaaggtttcgccatcgcactgcgcaagtttaagcacgccgagcagcgtgctgccggacatcagcggcagcaggcacagcgtctggatcttattgccccaggtttcaaacagccgacgctcataaggggccagtttgtcgcgctcgtgcagtttcagcaccagcacatccttgctgttaaatacccgctcggagagcgtacccgcctcgtccacttcactttgctcatgcaccggcgagcggtcattcggataatgggtggagtaaatattgagtttgcctttacgactgctgcgcagcacgatgctgatggcgtcgatgtggaaatagtggtggatctctttcgccacctcgctgaccagatcgtcaatgtccagccgggacaataccgcattggtaatggccaccagaatgcggaagttatcccgctcgcggcacagcagttcgtgatcggatgcgccgtcagggtgctgctgaatatgttccatcaccacgccggtgagctgggcgagggtatgcagacgggcgtactctttctcgctccagggcctgtccgcctgacgaataaactcgcagccgccgaagatccgcccgtcaatcgccagaggcagcagagagtagtgtccccagggatcgtacaggccgctggccgccagctgcggccaggtgtcgcagaactccgcgtaattgcagtgcagcgcctccgggcgtgacagaatgcgccgcaccgggccgtgcgccagcagcgtgtcatcttcatatttcaccgcgcggccatctgcccgcgtggcgtaatagcgggcatgatgatcgtcggcgttccataatacgatcgctgcgctgtccgccaggtctgacgccttcaccagctgcgtcaggctctgacagagcgacggcagatcgggctgatgtaataacgtgcgcgtaatatcaaacaggccctgctgcccgagatcgctcatcggtgtatacgacatatcgctagtccagaaaggcaccgaaagccggtgcaaaaagagttttaatgaatacaggtggcggcggcgcaaatatcagcaaatgcgcggcagcggctcagcgtgcggcagatccagtatgcgcttcacgccatataatccggcgagacgcacgcccttgcgcccgaccacttcgcctatcagcgccgcgtcgcggccgagcggatgggcgcgcagtcgctccagtaccgcatcggcggcatggcgttccacggcgatcaccagtttgccttcattggcaaaattcagcgcctccagccccagcagttcacagacgccgcgcaccgccggtttcatcggcaggtcggcctcgcgcagttcaataccgtagccgcagctggcggcaaactcatgggccaccgcgttgacgccgccgcgggtggcatcgcgcagggctttgacgccgggaatatcgcgcagagactggacaagcggcgtcagtacggcgcagtcgctcaccagatcgccatccagaccgaggttttcccgcagattgaggatggtcgcgccgtgatcccccagcgtgccgctcaccagcagcagatcgccgggttgcagctgttgcgccccccagcggatcccggcggggatagcgccgatcccggcagtgttaataaaaagcttatccgccgcgccgcgctgcacgactttagtatcgccggtgacaatcgcgataccggccgctttcgctgtcgccgccatgctgttgaccactgcccgcagcgtgtcgaggggcagtccttcttcaaggataaacccacaggagaaaaagcgcggcagcgcgccgcttaccgccacatcgttagcggtgccgcagatggcgagcttgccgatgtcgccgccggggaaaaacagcggatcgataacgtagctgtcggtggaaaaggccagccggtcgcccgcggcgctcagcgtggcgagatcaaggcgcgcctgatcttcctgctccgccagccagggattgtcaaaggcctgcataaacaggctgccgatcaactgctgcatcgcctggccgccgctgccgtgggccagttgtacggtactcatgcttcactctcctgactgcgatactgataccaggcggcgcaggctccctctgaggagaccatcagcgcgccaaaggccgactgcggatcgcaggttttgccgaacagcgggcactggtgcggtttgcatttaccggtcagcacgtcgccgcagcgggcgcgcggatcgtcatacgcctgctgcggggcagggcgaaaatgcgcctgcgcatcaaatgactggtacgccggtgtcagctgcacgccggagtgttcgatcatgccaagcccgcgccactcgcttttgccttcgacgcagaacacctcggccatcgcctgacgggccagcgcgttgccgccatcgggcaccacgcggcggtactgattttcaaccagactgcgggctgctattttctgctcaaccagcatcagtacgccttgcagtagatcaagaggttcgaaacccgccaccactaacgggcgctgaaagtcgctggcgataaagccgtaggcgtcgataccgatcaccatgctgacgtgccccggcgctaaaaaggcgtcgatgccgttgtccggcgcttccagcaggctgcgcagcgtcgggatcagcgtgatgtgctggcagaaaaaatagaaattatcgagcccgcgcgccttcgcctgttgcagcgtaatggcggtggcgggcatggtggtctcaaagccgaggccgaaaaacaccactttgcgctgcgggttttccgccgccagcgtcagcgcgtccatcggcgaatagacaatgcggatatccgcgccgcgcgctttcgcctgcaacagcgaaccgttttttcccggcacgcggatggcatcgccgaaggtgcagaaaatcacctccggacggctggcgatctccacgcaggtgtcgatgcgtcccatcggcaacacgcagaccgggcagcccggcccgtgaatgaattcgatattgtccggcagcagctgatcgaggccgaatttaaaaatcgcgtgggtatggccgccgcacacttccataatgcgcagcgggcgggaagcggtgtaagagagctggcgggcgcgatcccgcaggcgatcgataagctgcatcacctgttccggggcgcggtattcatcaacaaaacgcatcaccggcctccgctgttgtgggcgtcaccgtacagcagaccgccgacgtccggctctacctcaaacatattttgcagggctctcagggtgtcgcgggcttccgcttcgttgatcacgctcatcgcaaagccgacgtgcaccagcacccactggccgaggcgcgactggcctgtttcatcggtgctgcccaccagcgtcagatccacatcacgctgaatgccgcagacgtccactttcgcctgtaaaccgtcgatggcgctgatctgccccggtacgcctatgcacattgttgcgcctccagccaggcaagccagctgtccatgccttcgccgctggtggcggagatcaggatcacttctatctgtggattcaccgcccgcgccgcctctaaacagcgttcgacgtcaaaattcagatagggcagcaggtcgattttattgagcagcatcagcgaggcggcggcaaacatatgcggatatttcagcggcttgtcttcgccttcggtgacggacagtaccgccactttatgccgctcgcccaggtcaaagctcgccggacacaccaggttgccgacgttttcgatgaacaaaataccgccgtcgtccagcggtaaacgcggcgcggcgtcggcgatcatctgtgcatccagatggcagcctttaccggtattcacctgaatggccggggtgccggtggcgcgaatacgcgcggcgtcgtttaccgtttgctgatcgccttcaatcaccgcgcaggcggttttgcctttcaggcgcagcagggtatcggtgagcagagtggtcttaccggagccggggctggaaaccaggttcagcaccagcagctggcgggcggcgaagcgcgcgcggttgcgggcggcaagctgattgtttttatccagcacgtcgatttccacttccagcatccggcgctggctcatgccgggcgcatgggtgcccgcctcgccatgaccataatgcagatcgccgctgtcggtttgcgttggactaaaggcggttttcatgccagtgatggtaagcccgggccgggcggcaggcgcgaagggcgccccgcgaaacgccgagtgcggattgtgctcgtcgccttctatatagagattgccttcaccgcaaccacaggtggtacacatatttcactcctgttcaatttccagacgctgaatttgcagaccgtcgtcggcgacaatctgtaagccgtcgctgtgacacagcggacaacggcgcacgcgctggctcagtaaggtgacgtactgctgacaatgcccgcaccagcactcggcctgttgctcatcgagatgcagtgtacaaccttccgccagggtgccacggcataccagatcaaagcagaagctcaatgcgctgctttcgacgcaggaaaatgcgccaatttttaaccacacgccggtgacgcgccgcgcgccgtgcgccgctgcctgctgttcgataagttccagcgcgcgctggcaaagggtaatttcgtgcatagcgcctcccgttagtcgatggcctaacgaatgcaataacgatgccagctctttttgacatgtcactgacgatgtcgacgctgacgaaatgacatgtcattttcgcgatggttttgttttttatctttaaaattcaatgtattaaaaactggcataaaaactgctaacaacggttatcgcaactaattgggtaacctgacatgaccatctgggaaattagcgaaaaagcggactacattgccgaacggcatcaacgcctccaggatgaatggcgtcattactgcaactcactggttcaggggataaccctgtcaaaagcgcggctgcatcatgccatgagctgcgcgccggaccgggatctgtgctttgtcttattcgagcactttccggtttacgtcaccctcgccgacggctttaacagccacaccatcgagtattacgtcggcagcaaaaacagcgacgacaaactgttgattgcgcaggcgcaactggggctggatggccgggttgacggccacgtcagcaaccgctcccgcgaagccgtactcgaacactatctcgataaaatcgccaccgtttaccacggcctgtatgccgccattgaacaggatctgcccatcgatctgcatcagctggtgaaccgcccgttacaaagggcgcaggcgtaaccgcacgggtgtcgatgagtgtcgaaacagacagtacatcggcatgatttcgtcaaaaatgaccacctgaggaatgcctggtgaatcgttttgtaattgctgactccaccctctgcattggctgccacacctgtgaagccgcctgtgccgagacgcatcgccagcgcggtttgcagtctatgccgcgcctgaaagtgatgcgcaacgaaaaagaatctgcgccgcagctatgtcatcactgcgaagacgcgccctgcgccggggtctgcccggtgaatgccattaaccgcgtcgatggcgcggtgcagctcaatgaaagcctgtgcgtcagctgtaagctgtgcgccatcgcctgtccatttggcgcgatagaaatgtccggcagccgcccgctgcatattccggccaacgccaatacgccgaaagcgcccgccgcgccgcctgcgccagcccgtgtcagcacgctgctggactgggtaccaggtatccgcgccgtggcggtgaaatgcgatctgtgcagcttcgatgacgccggtcccgcctgcgtgcgcacctgcccgacgcaggcgctgcatctggtcgataaccatgacatcgcccgcgccagcaaacgcaagcgcgagctgaccattaacgcggatttcggcgatctgtcggcgctgatgctgccgccaggaggtacacattgaacgcgctttcactcattaacagcgcgctgctgtttttttccgcggcggcgttgctggcagcggcattttcattttataagccgctgagcggcgtgatggcagggctgggcggcgcgctcgccagcgtcatgacggcgggggccggcgcgctggtactgctcgacggcgtggcggtgcagggcacggtatcgctggcgggtatggggatgctgatcacgccgctgtctgcgatctggcttatcaccctcggcctgtgcgggctgtttgtcagcctgtttaaccttgactggcatcgtcatgccggggtgcaggcgaacggtctgctgatgaacgccctgatggcggcggcggtgtgcgctgtcgttgcagataactttggcgtgctggtggtcatggcggagatcatggcgctgtgcgcggtgtttcttaccggctgcggccagtcggcaaaactgtggtttgtgctgggccgggcgggcacgctgctgctggtcgtcagctgcgggctgatctggcagcgttatcacacgctggatctgacgcagatgaatatggccgcccaacagttaccgctgagcgccgggatctggctcaccggcgtggccggatttggcctgctggcggggatcatcccgctgcacggctgggtgccgcaggcccatgcgaatgccagtgcgcccgccgcggcgctgttctccaccgtggtgatgaaaatcggtctgttcggcatcctgacattatcgctcgcgggcggtaatccaccgctgtggtggggcattgtgctgctggcgctggggatggtgacggcttttgtcggcggcctttacgcgctgatggagcacaatattcagcgtctgctggcgtaccacacgctggaaaatatcggcattattttgctcggtctgggggccggtctgaccggcatcgccctgcaacagcccgcgcttatcgcccttggcatgaccggcggcctctatcacctcatcaaccacagcctgtttaaaagcacgctgtttctcggcgcgggcagcgtctggtatcagaccggacatcgcgatattgaaaaactgggcggtatcggcaaacgcatgccgctgatctcgctcgccatgctggtggggctgatggcgatggcggcgctgccgccgctcaacggctttgccggggagtgggtgatctaccagtccttcttccgcctgagcagcagcgagctgtttatcggccgtctgctcggcccgctgttagccgtggggctggcgatcaccggcgcgctggcggtgatgtgtatggcgaaagtctatggcgtgacctttctcggcacgccccgcaccccggaggcggcaaacgcccgtcctgcgcccttgctgatgaccttctccgtggtggcgctggcgctgtgctgtatcgcgggcggcgtgggcgtgccctggctgctgccgctgttatcaacggcggtaccgctgccgcttgccaccgcgcagaccagcgtgtcacagccgatgatcgcgctgctgctggtggcctgtccgctgttgccgctgatcatcatgctgttgttgaaaggcgaccgtttaccgggacgccagcgcggggcggcatgggtgtgcggttacgatcacgagccatccatggtgatcaccgcccacggttttgcccatccggtgaaagccgcttttgccccggtgctgaagctgcgtcactggctggatccggtcgcccgcattcctggctggcagcatgaaggggcggcggtactgttccgtcgcctggcgctgatcgagctggcggtgctggtggtggttgtgatttcccgaggagcctgaacatgaatctgctgtttccgttacttcaggcgctggcgctgtttgccttcgcgccgctgctgtccggcgtaacccgcgtggcgcgcgcccgtctgcataatcgccgcgggccgggggtgctccaggaataccgcgacctgatcaagctgttcggtcggcagagcattgcgccggacgcggcgggctgggtgtttcgcctgatgccgttcgtgatggtcggcgtgatgctgaccatcgccaccgcgctgccggtgatcaccgtcgcctcgccgctgccggtgctgggcgatctgatcaccctgatttacctgttcgccattgcacgcttcttctttgccatcgccgggctggataccggcagtccctttaccgggctgggggccagccgtgaggcgatgctcggcgtactggtagagccgatcctgatcctgggactgtgggtcgccgcgctggtggcgggttcgacgcacatctcttatatcgccgccgcgatttaccactggcccgccgggcgcagcctgccgctgatccttgcgctctgcgcctgtgccttcgccacctttattgagatgggcaaactgccgttcgatctcgcggaagcggagcaggagttacaggaagggccgctgaccgagtacagcggcagcggctttgcggtgctgaagtggggcatctgcctcaaacagctggtggtgctgcaactctttgtcggcgtctttttcccctgggggcagatgatgcacttcagcgtgaccggcctgctgctggcgctggtgattgccgtggtgaaactgcttgtcggcgtgctggcgatcgccctgtttgaaaacagcatggcgcggctgcgtttttgcgccacctcgcgcgtcacctgggccggtttcggctttgcctttttagccttcgtctccttgctggcggcgtgatttaagagaacttatgtatgtctgaagaaaaaatcggtcaacactacctcgccgccctgcatcaggcctttccgggcgtggtgctggatgaagcctggcagacccgcgatcagctcaccctgacggtgaaagtgaattatctgccggaagtggtggagtttctctattaccagcagggcggctggctgtcggtgctgttcggcaacgacgaacgccagctgtgcggccattacgccgtctactacgtgctgtcgatggagcagggcatcaaatgctggatcacggtgcgggtggaagtggacgccagtacccttgagtttccatcggtgacgccgcgcgtaccggcggcggtctggggcgagcgcgaagtgcgcgacatgtacggcctgcgcccggttgggctgccggatgagcgtcgcctggtgctgccggatgactggccggacgaactctatccgctgcgtaaagacagtatggattaccgtcaacgcccggccccgaccaccgacagcgaaacctacgagtttattaacgaactgggcagtaagaaaaataacgtcgtaccgattggcccactgcacgtcacctccgacgaaccgggccatttccgcctgtttgtcgatggcgaaaacattatcgacgccgattaccgcctgttctatgtccatcggggcatggaaaaactggcggaaacccgcatgggctataacgaagtgactttcctgtcggatcgcgtgtgcggcatctgcggctttgcccacagtaccgcctacaccacctcggtggaaaacgcgatgggcattaaggtgccggagcgtgcgcagatgatccgcgccattctgctggaagtggagcggctgcacagccatctgctgaacctcggcctggcctgtcactttgtcggctttgactccggctttatgcagtttttccgcgtgcgcgaaacctccatgaaaatggcggagatcctcaccggcgcgcgtaaaacctacggcatgaacctgatcggcggcattcgtcgtgacatgctgaaagacgacatgatccagacccgtcaactggcgcagcagatgcgccgcgacgtaatggaactggtggatgtgctgatgagcacgccgaatatcgaacagcgtaccgtcggcattggccgtctggatccgcaaattgcccgtgacttcagcaatgtcggcccgatggtgcgcgccagcggccatgcgcgcgatacccgcgccgatcacccgttcgtcggctacgggctgttgccgatgacggtgcacagtgaacagggctgcgacgtcatctcccgcctgaaagtgcgcatcaacgaagtgctgaccgcgctcaatatgatcgactttggtctggataacctgcccggcggcccgctgctggtggagggctttacctatatcccgcaccgttttgccctcggttttgccgaagcgccgcgcggcgatgatattcactggagcatgaccggcgacaaccagaaactctaccgctggcgttgccgggcggcgacctatgcgaactggccgaccctgcgctatatgctgcgcggcaatacggtatccgacgcgccgctgatcatcggcagcctcgacccctgctactcctgcaccgaccgtatgacggtggtggatgtgcgcaggaagaaaagcaaagtggtgccgtacaaagagcttgagcgctacagcatcgagcgtaaaaactcgccgctgaaataaggagtcgccatgtttacctttatcaaaaaagtcatcaaaaccggcgcgccgacctcgtcgtacccgctggagccgattgccgtcgataaaaattttcgcggcaagccggagcacaatccgcagcagtgcatcggctgcgccgcctgcgtgaacgcctgtccgtcaaacgccctgagcgtagaaaccaatctggcccgtggcgagcaggcctggcagtttaacctcgggcgctgcattttttgcggtcgctgcgaagaggtctgtccgacggcggccattaccctgtcccaggcctatgaactggcggtatggaagaaagaggatttcctgcaacagtcgcgctttgcgctgtgcgaatgccgcgtctgcgcccggccctttgccgtgcaaaaagagatcgactacgccatcgccctgctgcaacacaacggcgacacccgtgcgcacgagcaccgggagagcttcgaaacctgcccggactgcaaacgtcagaaatgcctggtgccgtcagatcggatcgaactgacccgccacatgaggaaggccagctaatgcaaaacctaattggaccgcgtgacgataacggcattccggtgccgatgacggtggatgaatccatcgcgcgcatgaaaacctcgctgctgaaaaacatcaagcgttccgcctatgtctaccgggtggactgcggcggttgcaatggctgcgaaatcgagattttcgccacgctttcgccgctgttcgacgccgaacgcttcggcatcaaagtagtgccgtcaccgcgtcatgccgacattctgctgtttaccggtgcagtgacccgcgctatgcgctcccctgcgctgcgcgcctggcagtcagcgcccgatccgaaaatctgcatctcttacggcgcctgcggcaacagcggcggcatcttccacgatctctactgcgtgtggggcggcaccgacaaaattgtgccggtggacgtttatattccgggctgcccgccgacgcctgccgccaccctgtatggctttgccatggcgctgggcctgctggagcaaaaaattcacacccgtctgccgggtgagcaggacaaccagcctgctgaactgttgcatgacgacatgatgcagccgctgcgcgtgcgggtggatcgcgctgcccgccagctggccggttatcgctatggccgccagattgccgatgattatctgcggctgctgggcaagggcgaacagcaggtggcgcgctggctggaagcagaaaacgatccgcggctgaatgaaatcgtgcagcggcttaacagcgtggtgaacgaggcgcgcatcagatgagcgagaaggtcgttttcagtcagttgagtcgcaaatttgtcgacgagaatgatgccacgccgcccgccgcgcagcaggtggtctattacagcctggcgatcggtcatcacctgggggtgatcgactgcctggaagcggcgctgacctgcccgtggcaggcgtatctggcgtggatcggtacgctggaggagggcagcgaggcgcggcgcaaaatggaaggcgtaccgaagtatggcgagatcgtcatcgaccattcgcacatcagcatgctggccaacgcctttgatcgcgcccgggcgcagcagacgccggagcagcaggcctggagccggacgctgctcggtatgctgcacgatatttatcaggagaatgccatctacctgatggtgaggagattacgtgactgatgttttactctgcgtcggcaacaccatgatgggcgacgacggcgcaggtccgctgctggcggaaatatgcgcggagcggggctgtgaagggtggacggtgattgacggcggcagcgcgccggaaaatgacatcgtggcgatccgcgagcttaaacccgcgaggctgatgattgtcgatgccaccgacatggggctgaaccccggcgagatccgcattatcgatcccgatgacatcgccgacatgtttatgatgaccacccacaatatgccgctcaactatctggtcgatcagttaaaagacgatgtcggcgaggtgatttttgtcggcattcagccggatattgttggcttttattatccgatgacgccgccggtaaaggcggcggtggaaacggtgtatcagcgccttgccggatggcaggggaacggcggtttttcaccgctgtgattgaaactctgcccggtgggaaatgccgggcggcgctgcgcttgcaccggcctacataatttcgacaatgcggatttttgtaggcccggtcaggcgaagccgccaccgggcaatgcaatttattccaaatccgcgccattactggcaatcactttcttataccaccagaaggatttcttgcgcgtgcgggcgagggtgccgttgccggcgtcatcgcgatccacatacacaaaaccatagcgcttgctcatttcaccggtggatgccgataccagatcgatacagccccatgaggtataacccatcagcggcacgccgtcttcgatggcgtcacccatcgcgcggatatgctcgcgcagatagcttatgcggtaatcgtcgttgatctcgccgttggcatcgatttcatcccgcgcgccgaggccattttccaccaggaacagcggcttctggtaccggtcatacatcatattcatggtgatgcgtaagcccagcggatcgatgccccagccccattcgctggcctgaatgtacgggtttttcagtgacttcacgatattggccgcgctggtgtttccggcgttcatatccgctgacgcgcagcgggaggcgtaatagctgaacgacacgaaatcgacggtgtttttcaggatctcatcgtcgcccggcgctttttcaatgtgtacgcctttctcgcggaacacgcgggcggaataggacggataggccccgcgcgcctgcacgtcgataaagaacaggttttcgcgatctttctccagtgccatccacacatcttccggcttgcaggaatacgggtaaaaattaccgcccgccagcatacagcccacctgattgtgcgggttcacctcatgggctattttagtcgccagcgcgctggcaatcagctcatggtgcgcggcctggtatttcacctggtcctgattttcaccttcttcaaacgccagtcccgcgccggagaacgggctgtgcagcatgatgttgatttcattgaacgtcagccagtacttcaccagcccgtcaaattcttcaaaacaggtgcgcgcatagcgggtgaagaactccaccatcttgcggttgcgccaggagccatattccaccaccagatgcatcggcacgtcgaaatggcacagcgttaccagcggttcaatgttgtactttctgcactcctcaaacaccgctttatagaaggcgatgccttccgggttgggcgtcagttcgtcgccattcgggtacaggcgcgcccaggcaatggaagtgcggaacaccgtgaagcccatctccgccatcagggcgatgtcttccttgtagcgatgataaaaatcaatcgcctcatggctggggtagaactcatcatcacgcagcgccacgcgcttttcctggcccagcttcaccggcaggcggtttgcgccatgggggatcatatcgacggtggtcaggcccttgccgccttcgcgatatgccccttcagactggttggcggccagcgcgccgccccataaaaatccttccggaaatacagacatgcttacttctccttaaatcaggctctggcttcggtgctgacgggcgctttcgccgcctgcaactcacgcgctttcgccgcttctttttccaccggaatatcttcaaagcccagcatcagcgtgagcacaaaggacagcaccaccgccagcgccatcacgccgaacacccagacgatgctcatcggattggccggatcgaagaactgcacgctggtaaacagtccgggtgctgccattgaatggctggcgagtccggcaatgcccgccaccgcgccgcagataaagccgctgatgaggctggcgataagcggtcgtttcaggcgtaccgccacgccgtacagcgccggttccgagatgcccgccagaatggcagaggcggcggctgccagcgccgtctgacgcagttccgggtttttcgttttccacgccaccgccagtgaggagccgccaagggagaggttagcgccaatttctgacggcatcaccatgccttctttaccggtttcggcgatggtctgaataatagtcggcgtaaacacgcggtgcatcccggtcatcaccagcagcggccacagcgcgcccataatggcgacggacagccagccaagataatcgtgaatggtgtacaccagcgcagagatggcgctgccgatccagataccgattgggccgatgagcacgatggcgagcggggcggcaatcagcacgatcagcatcggcttgaggaagtttttcgtcaccgccggggtgatcttatcgacccagcgttcgatataagacaggcaccaggtcatcaccagcgccgggatcaccgtgtaggtgtacttcaccgccgtcaccgggataaaggcgaattcgacgtgctcgccctgagccgctttcgccatcagctcgataaagctcgggtgcaccagcacaccggcaatggctatcgccagcgacatgttggttttaaatttgatcgccgccgaagccgccaccatcagcggcaggaagaagaaggccccgtcgccgatcaccgtcaggatggtcagcgttggcgcgcctttttccagcacgccggtcatctccagaatcatcgccagcagcttgaccatcgatccgccgatgatcgccgggatcaacggggacatggtgccgatcagcgcatccagaatacctgcgccgatgcgctttaaggtcagtttctgttttgatgcggtttccaccggctgcatatctcccggcagcaggctcaccacttcgcggaacgcctgcgagaccgtgttgccgatgatcacctggcactggttatcgttacgcaccacgcccattacgccgctgatgcttttcaggccgggagcgtcgatgagcgattcatcttttactacaaagcgcagacgcgtcatgcagtgcgtcacggcagcgatattgtcaacgccgcccagcgcagcaatcacagagtgggcaagcgccgcataattcttagccatcgggaagtaatcctgttttatcagtaagatacgctttcattgtcagacaatgacacagcagataggaaaccggttccacaaaagaatgattagttcttgtaaatcaaacaatgatttttatattgatttgtgatgaggttcgctaaatatttgattggctgtaggccgggcaagacgtagtcgccgcccggcaccaaagctgcaaactgcgtgactgtgaagtacactgccgcttatcgacattaaagggataatgatcatgacgacgatgctggaggtcgcgaagcgggcaggggtgtccaaagccacggtatcccgcgtgctgtcagggaatggctatgtgagccaggaaaccaaagaccgggtatttcaggcgattgaggagagcggctaccggcctaatttgctggcgcgcaatctggcgacgaaaaagacgcagacgctcggtcttgtggtgaccaacaccctctattacggcgtctatttcagcgagttgctgttccatgccgcgcggatgacggaagatcatggccgccagctgatcctcgccgacggtaaacacagcgctgaagaagagcgtcaggcgatccagtatttactcgatatgcgctgtgacgcgatcattatttatccccgttttctcagcgtcgatgaactggatgcgcttgttgaaaatcacacccagccggtaatggtgcttaatcgtcggctgcggaaaaacagcagccactgcgtctggtcggatcaaaaacagtccagctttaaagcggtgtcgactttattagcccgcggccaccgggatattgcttttattaccggctcgctggattcgccgaccggtattgaacgtctggcgggctataaagatgcgctggcgcagcatggcgttgcgctgcgcaacgatctgattgtcgaaggaaaatggacgcctgccagcggcgctgagggcgtgaaaacgctgctctcacggcagcaaagctttaccgcgctggtggccagtaatgacgacatggcgattggcgcaattaagcagctgcatgaggcgggaataacggttcccgaacgggtttccgtgctgggattcgatgatattgcgctggccccttatattgtgccgtcgctgtccagcgtgcgtattccggtcacggaaatgatcaaagaaaccattaaccggttaatctttatgctcgacggcggtgaatttaaatatcagcaaacctttgccggggaattacattcccgcgactccatcattgacgggccacacgcctgacgtcgacaggtgtcatcgtcactcgtgtcgatgacacttcctttctgcctcgtcttttctaaaatatacataaatatcaatacattaaaatctggcacgattcatgaatagctccgcggtaacctttacagccggagaacccgatgaaccgtttcatcatggcggatgccaataaatgcattggctgccgcacctgcgaagtcgcctgcgtggtttcgcatcaggaagatcaggactgcgccgccctgacgcccaccacctttctgccgcgtatccatgtgattaaaggcgtgaatatctccaccgccaccctgtgccgtcagtgtgaagacgccccttgtgccaacgtctgcccgaacggcgcaatcagccgcgataaaggctttgtgcatgtgatgcaggaacgctgcatcggctgcaaaacctgcgtggtcgcctgcccgtatggcgcaatggaagtggtggtgcgcccggtcgtgcgcaacagcggcgcgggcctgaacgtgcgcgccgaaaaagccgaagccaacaaatgcgatctctgccatcaccgtgacgccggtccggcgtgcatggaagtctgcccgacccgggcgctggtctgtgtcgaccgcaatatgctggaaaaaatgagcgccgataaacgtcgtcgttccgccctggataccaccggcatgctgttttaacccgaacccgatttcaacttttaacaggtctgttactgatgaaaaaaatcacaagcgtatgtccctactgcggcgcaggctgcaaacttaaactggtcgttgagaacaataaaatcgtgcgcgcggaagccgccgaaggggtgaccaaccagaatcagctgtgcctgaaaggctattatggctgggattttctgaacgatactaagctcctcacgccacgcctgacgcagccgatgatccgctacgaaaaaggcggcaaactcacgccggtcagctgggacgaggcgatccgctataccgcaaaacgcctgggcgagatccgcgcgcagttcggcccgcgcgccatcatgaccaccggttcgtcccgcggaacggggaacgaaaccaactatgtgatgcagaaattcgcccgcggcgtgctcaataccaataacgtcgactgctgcgcgcgcgtctgtcacggtccatcggtggcgggattgcaggaaacgcttggcaacggcgcgatgagtaactccatcggcgacattgaaaattcccgctgcctgctggtatttggctataactgcgcggattcgcatcccattgtggcgcgtcgggtgatcaaggcgaaacagaacggcgcgaaaattatcgtctgcgatccgcgccgtatcgaaaccgcgcgcatcgccgatcagcatctgcaaatcaaaaacggctgtaatatggcgctggttaacgcctttggttatgtgctgctggaagagcagctctacgacaaagagtacgtcgccagctttaccagcgggctggacggctaccgggaaacggtaaaagattatgcgccggaaaaggtagagcacctgaccggcgtgtcggcgcagcagatccgtcaggcgatgcgcacttacgccgccgcgccgtcggccaccattatgtggggcatgggcgtgacgcagttcggtcaggcggtggacgtggtgaaagggctggcgagcctggcgctgcttaccggcaatctggggcgcgagcacgtcggcgtcgggccggtgcgcgggcagaataacgtgcagggggcgtgtgacatgggcgtcatccctaaccagttccccggctatcaggatgtggtggatccggcggtgcgcgcaaaattcgctgccgcctggggcattaaccctgacgatatggacgataaacccggcgtgcgcatcaccgaagtgccgcatctggccatcgaaggcaaagtgaaagcctattacatcatgggtgaagatccattgcagaccgaagcggatctgggcctggtgcgcaaaggctttgcggcccttgattttatcgtcgtgcaggacattttcatgaccaaaaccgccgagcaggcggacgtgatcctgcccgccacctcctggggcgagcacggcggcgtctttacctgcgccgaccgcggcttccagcgcttcgaaaaagccattgagcctgcctataacgtcaaacgtgactgggaaattatcagcctcatcgccactgagatgggctacccgatgcactacgacaataatcagcaaatctgggatgaactgcgcgagctgtgcccgctgttctatggcgtgacgtatgaaaaaatgggcgatatgggacacgtgcagtggccttgcccgaccctcgatcaccccggcacgcctttcctctacaaaggcaataaatttgatacgccggacggcaaagggcatctgtttgccgccccgtggcgcgcgcctgcggaagtgccggacgccgactacccgctggtgctgtgcaccgtgcgcgaagtggggcactactcctgccgctcgatgaccggtaactgcgcggcgttgcaaactctggcggatgagccgggttttgtgcagatcaacccgcaggacgcccgtgcgctgggcattcaggatcggcaactggtgtgggtttcctcgcgccgtggcagggtgatcagccgtgccgatgttaacgagcgtatcaacaccggcagcgtgtacatgacctatcagtggtggattggcgcctgtaatgaactgacccaggacaatctcgatccgatctccaaaaccccggaaaccaaatattgcgcggtgaaggtgagcgcgatcgacgaccagcgctgggcggaagattacactcagaccacctatctcgagatgaaaaaccggctgcgtgatgcagtggtatgacaggacagaatgagtaataacggcgtactgatacgtgtacgcggcaaggtgcagggggtgggtttccgccccttcgtctggcagctggcgcaacaactcgatctgcgtggcgatgtctgcaacgacgggcacggcgtcgaaatccggctgtccggcgacgccacgcgttttcttcgcgagctgtatcagtactgcccgccgctggcgcgcattgacgatacggaggtgaccccctggcagtgggacgacgcgcccaccgccttcactattcgccacagcaccggcggcagcatggacacgcagattgtgccggacgccgccacctgcccggcctgtctggcggaaatgaacgatcctgctgagcgccgctatcgctatccctttattaactgcacccactgcgggccgcggtttaccattattcacgccatgccttacgaccgtccgttcaccgtgatgcgcgcctttccgctgtgtccggtctgtgatgctgaataccgcaatccggcggatcggcgttttcacgcccagccggtggcctgcgcagagtgcggcccgcagcttgaatggcaggcagcaggggtaagcgaagcgggcgaggcggcattgcaggcggcaatcgccatgctggcggcgggaaatattgtcgccattaagggccttggcggttttcatctcgccgttgatgcgcaaaaccagcaggcagtgatgcgcctacgggaacgtaaacgccgtccggcaaaaccgctggcggtgatgatcccctgtggctgctgtgaggtggcagcagagcacctgcaatccgccgccgcgcccattgtgctggtggcgaaaagcgcgctgccggatctgtgcgaggccattgcgccttcgcttgcggaggtgggcgtgatgtggcccgccagtccgctccagcatttgctgatgcaggcgctggatcgtccgctggtgatgacctccggcaacctcagcggacgaccgcctgcgcttaccaacgaccaggcgctcaacgatctggcggacattgccgacggctttttgctgcataaccgcgacatcgtgcagcgcatggatgactcggtgatgcgcgtcagcggtgagatgctgcgccgggcgcgcggctttgtgccggacgcgctgccgctgccgccgggcttccaggatgtgccgccgctgctctgtctgggggcggacatgaaaaataccttttgcctgctgcggggcgaccgggcggtgctgagccagcattttggcgatctcaccgatgacggagtggaaacccagtggcgcgccgccctcgatctgatgcagaaaatttatgatttcgtgccgcagcaggcggtgtgcgatgcccacagcggctatcgcgccacgcaatggggcgaggcgctcggcctgccggtgagccacgtgctccatcatcacgctcacgcggcggcttgtctggcagaacaccgctggccgcgtgacggcggtgacgtgatcgcgctgatccttgacggtattggcatgggtgaaaacggtcgtctctggggcggggagtgtctgcgggtgaactaccgcgaatgcgagcacctcggcggcttaccggcggtggcgctgcccggcggcgacctggcggcacgacagccgtggcgcaacctgctggcgcactgtctggcctttgtaccggactggcagcgttatccccagacccgcgtgctacaggataaaaactggccgctgctggcgcgggcgatagcgcaggggatcaattcccctcgcgcgtcatcctgcgggcggctgtttgacgccgtagcctgcgcgctcggctgcgcgccggaaagcctgagctacgagggcgaggcggcctgtcagatggaggcgctggcaagtgaatgttccggtgtggatcatccggtggtgttgcagccgcaggatttgacgacgttctggcagtcgtggctcaggtgggacgcaacggtaagcgaaaaagcctgggcgtttcatgatgcgctggcaaaagggctggcggggctgatgcggcgcgaggcgcaggcgcgggggatcacgacgttgtgttttggcggcggggtgatgcacaaccggctgctggtggcgcgcttagggttttatctgggggagttcaggttgctgtttccgaaggggttaccggcgggggatggggggatcgcattggggcaggggattattgcggctgcacgcttggtgtaatgtggtaagttgcgctcttactgacttctgcgtacgactcagacttcaggcgcacagagcgcgcagggggcggccagtcgccgccgccccctgcacccccgggctcccggcaagaaaatcgccgcttcgcggtgccctcggcttatcccttccggcttcgggtcgggcgcgatgcagcgtccctgcaagtcgcgccctcagcccgcatccatgcgggctgccccggccgtaagggaacgcctcagcgattttcagccggactccccacacttcacgatttttaaaaaacaccactcacagcttcctgtaagttcgtaaaaaaattaacgccactccgtcgccttataaaaaataaagataatgacgcgaggggttgagtccccgctgaaaccggcgagccggaggccggatgacaagggctggacgccatggatggcggccagaggcgatatgaggcaggaggccgaattgagccgaccgcgggcagacgggcgggaggtgagcgcagtgcgcagcaccggtttctgtgcggggccgcggggattgctaagggggccgcggtggcccccttagcacgttcaccgtcagcggcgtcacgcctgacacggaacgcaaagtgaacggaatattccaccacaccgaacattccaccacaccaaacatcccaccgaacagccccaataaacctacccgttcagcgccttcagcaacccaaacgcctccttcatccgatcctcactcaccacaaacgcccgcagcttctccccctcaaaccccttcgccaccatcccgtccgggcgcgcctcgatctgccagtgcagatccccgcgctgtgtctcgcccgccagatgcagcggcagatccggcgtcttcactttcaccagcatcggcggcagcgacagcgtggcctgctggcccagcagcgtcttcgccagccacatcgcgcaaatctggatcggttgcaggaagggcagcagcttaccgttgatctccgcgcagtcccccagcgcataaatatcctcaatactggtgcgcagctgactgtcgaccacaatgccgcgtctgacggcaatacccgcctgactcgccagcgcggtttgtggtttcaggccagtggcggccaccaccgcatccacctcaaggaggcgatcgcgatcaaaacgcgcctgaatgcccccggcggtagactccagcccaagcaactgcgatttcagcagcagatgcacgccgctctccgtcagacggtgttgcaggcggctgctcacttccggcggcatcagcgaagaaagtatgctggcggcggtatccaccagcgtcaccgttttaccggcgcggttaaaatccatcgccagctcagtgccgatcagcccgccgccgacaatcagcacgcgctgcgcatcgcgcagggtcgcgccgcacgcctgatactcctgctgactgttcagcgtcagcatcagctcgctgcccggcaccggcggcacaaaggccgaagcccctgtcgccagtaccagcttgtcgtaaaaccactcctgctgctggcttttgacgcagcggcgggtgggatcgatttccgtcacccgcgtctgcgggaacaggcgcagattgaactgttccgcaaactcccccgccgactggcgggtgagatcgtctgcggactggccgaggctgatcacgtggctgagatccggtttgttgtattcgtccatgctgtcagcggcaatcagcgtgaccggaacctgcgcgtcctgtttgcggatattttttaccagctgtcgggcggcgaagcccgaaccaataatgacgataccctgattcattttgcctccacggccagcacatcaaacacgtctttacccagtgaacattccgggcacaggaagttgtccggcacctcgtcccacggcgtgccgggggcgacatcctgcattggctcgccggtggccggatcgtagatccactgacaaacgctgcactgcatgcatgggccgaggtcagcggcggcaggctcgctgacgctttcttcctgcggttttacgttcggggcagcagcggaaggcagcggggtaagcgcccactgacgggcaatatcacgaccgtgctggcggcagatttccagcgcatcaatatccggacgccatttggctttcaggctgagtgacatttcaaaaccggcatcctgtaaacgcgtagacaggcggtccaccgcgccgccgctccagccgtgggagccaaaggcactggcgcgtttattgcggaagcgcagcccggttatctcttccaccagcccggcgattttcggcatcatcacgttattcatggtggaggtacccaccagcacgcctttggagcggaacacgttggtcagcacctcgtttttatcgctgcgggcgacgttgaagattttcaccgccacgcggggatccacttcggtgatgccctgggcgatggcgtcggccatcatgcgggtattgttcgacatggtgtcgtagaaaatggtgatgcgatcttcctgataatccgctgcccatttcaggtacagctcgacgatttgcgtcgggttatcacgccataccacgccgtgagaggtggcgatcatatccaccggcaggttaaagccgaggatttcggtgattttcggcgtcaccaggcggctgaacggcgtcaggatgttggcgtagtagcgctggcactgctcgaacagttccacctgatccacttcgtcattaaacaggtgttcgtcgcaatagtgctgaccgaaggcgtcgttactgaacagcaccgcgtcgccggtcatgtaggtcatcatgctgtccggccagtgcagcatcggggtttcaacgaagatcagctgtttaccgttaccgatgtccagcgtgtcgccggttttcaccacgttaaaattccactccggatggtggtgatgaccgttgatggaatcgatggcgttattggtgcagtaaatcggcgtgtccgggatgcaggacatcagttcggtcagcgcaccggcgtgatcttcttccgcatggttgatgatgatgtagtcaatatccgcaaggtcgatttcagcgcgcaggttctgcacgaattcacggctgaatttgtggtcaacggtatcgatgagcacgtttttctcttcgcggatcagatagctgttatagctgctgccgcgcagggttttgtattcggtaccgtgaaaatcgcgcacttcccagtcacgttgtccaacccagtgaatattattttttacatgaatagtcatattaacctcagccactctgaatttgagaaagatgtctgacatatatcaagatgcgtgccagttttttattttatttaaaatcaatggtttgatagatttttggtaaaggtagtttgtcaaaatgactatgctttttatggtcaatatgacactatgcattgtcaaaatgactgtgaggtgggtatgcgtttttccgtggaagcactggcgaaaatcgccattgaactgcaaagcgatatcggtcatcaggatcgcttttcccggctgatcgccacgctgcgccaggtgctgggctgcgatgcctcggcgctgctgcgctatgaggcgcaccagtttattccgctggccatcgacgggctggcgcaggatgtgctggggcgacgcttttcccttgccggacacccgcgcctggaggccatcgcccgcgccggggacgtggtgcgctttccggcagacaacgatctgcccgatccctacgatggcctgatccccggccaggagagcctgaaagtgcacgcctgtctgggcctgccgctgtttgccgggcagaagctgattggcgcgttgactctcgacggcatggagccggatcaattcgacggcttcagcgacgaagccctgcgtctgatagccgcgttggtggccggggcgctgaataacgcgctgctgattgcccagctggaaagccagaacgtgctgcccgccggggaaagcagcttcacgccggagcgcggacaggagatgatcggcctcgccccggcaatgcagcagctgaaaaaagagatcgatattgtcgccgcctcagatttgaacgtgctgatcagcggcgaaactggcaccggtaaagagctggtggcgaaagcgatccacagcggatcgccacgggcggtgaatccactggtctacctgaactgcgcggcgctgccggaaagcgtggcggaaagcgaactgttcggtcatgtcaaaggggcctttaccggggcgatcagcaaccgcagcggtaagtttgaaatggccgataacggcacgctgttccttgatgaaatcggcgagctgtcgctggcgttgcaggcgaagctgctgcgtgtgttgcagtacggcgatattcagcgcgtcggcgatgaccgcagtttgcgggttgacgtccgggtgcttgccgccaccaaccgcgatttgcgtgaggaagtgctggcggggcggtttcgcgccgatctgttccaccgtctgagcgtttttccgctgtttgtaccgccgctgcgggagcggggcgaggatgtgatcctgctggcgggttatttctgcgagcagtgccggatgcggctcgggctggcgcaggtggtgctaagccccggcgcgcgggcgcagctgctggcgtatggctggcccggcaacgtacgcgagctggaacatgccattcatcgcgcggtggtgctggcgcgggcgacgcgggcaggggatgaagtggtgctggaagcgcatcactttgcctttaccgatgaggctgcgcctgcggcaacgcccgtcatcagcctgccagtgaacgacgccgcgctgaacctgcggacggctacggaagattttcagcgccagctgattgagaatgccctgcgcgcccacgaccataactgggcggcaagcgcgcgggcgctggagatggacgtcgccaacctgcaccggctggcgaagcgtctggggctgaagggctagagaatgcccgcctggtagaagtcctgtaagttgatagcgccggtgagcacgccgttttcatccaccaccggggcggcggcgattttgcgcttcatcaggatctctttggcatcaatggcgcggctctgcgcctgtagcgtgacgccgcccggcgtcatggcgtcacgtaccgcggcgtccagcgtgccgccgcccaccagccagcggcgcaggtcgccatcggtaaataccccctgaacgtgctgcgcgctgtcgcataccgccaccagccccagcccggtgcggctcagttccagcatggcgtccatcacgctggtgtcgagttgcacctgcggcagggcgtcaccggtacgcatcaggtgatgcactttattaagcaaccgcgcgcccagcgcccccgccggatgcgaacgggcgaaatcttcttcgttaaaaccgcgcgcctgcatcaccgccatcgccagcgcgtcgcccatcatcagcgtgttaacggtgctggaggtgggcgcaaggtgcatcgggcaggcttcacgctccaccgaaatgtccagccaggctttggcggccagcgccagcggggagcgggatttaccggtcatcgccagcagcgcgacgcctttttcttccagccgcgggatgatcagatccagctctttggcggtgccggaataggagataaacagcagcaggtcgcggctttcaatcatgccaagatcgccgtgcagcgcttccgccgggtgcacaaaaaacgccggggtaccggtgctggcgagggtggcggcgatcttcttgccaatgtgtccggatttgccgatgccggagacaatcactttgccttcgcagtgcaggatggcgctggcggcgcgcacgaagtcgtccccgaggcgttccggcagacggctggcttcctgtaattccagcagcagggtctggcgggcggtatttaacagatgttcactcatggctctctccggcaataatcacatcaattcctttgtcttccagtgcggcgcggaactcttcggaaattcccgcgtcggtgatcagtttatccacgctctccaggctacagacgatattcgggcttttgcggccaaactttgaggagtcggccatcaggatcacttccctcgcggcgttgcacatggctttactgacggtaaacacttcgttgaaggtggtgacgcccgcgctgagatcgatgccgtcggtgcccataaacagcttatcgaagctgaaatgctcaaaggcgttttccgccagctggccgtggaaggaggcggattttttacggaaagtgccgcccggcatcagtatggtctgctcgttgtccagctccgacagggcgttaacgatgtgcaggctgttggtcatgaccgtgatgttattaaagcggctgagcagaggcaccatttgcagcaccgtactccctgcgtcgaggatcagcgaatcgccatcgtgaataaagcccaccgccgtttcggcgatgcgcgctttctgagtggtgttaatcagcgctttatgatcgataggcggatccgcttcgtccttattaagcacgacgccgccataagtgcggatcaccgtaccggcgtgttcgaggatcaccagatctttgcggatggtggtgccggtggtgtcgaactgctgcgccagttcatcaaccgaacattttccccgctgatgcagatgttcgagaatagcggcctggcgctgacgtggtttcataagcgtggatcctgcgtaaaagtgcgaactgataatttcgcaagctaaaagcgttcacaacgaaattacccatgtttcattttaagcgctaatgatagagcattctgacagcgcggatcatggggaaagatcacatcagggcgtaattcatcacgatgtttgccggtaagcgcggaaatttttaacggtctggcgaaaaccgtcagtcctttcatcaataaggtgtccgtcacgcgctgctgttcatccagcgcgacggcgatgaccacgcggggctgaaaacgtccgccagcccgcccgacgccgacccgcccgcgctggcacagctgctcaaaggcgcggttaaactggcggatctgccagccgcccagcgccatctggccgatccaggcgatggcggcgacggtgataagtgccgttaccatagtgactccttaattgccggaattgccgggtggcggctgcgccttacccggcctacggtcatggagggttgtagccccggtaagcgcagcgccaccggggaatgaactcaaaacatcacctgcccgccggtgatattaatcgactgcccggtgcagtaagacgccagcgggctggcgtaaaacagcagcaggttaagcacatcctgataatcgcagccgcgcttcagcggcactttatcaatgtaatgctgctccacctgatcggcgggaataccgagcttgctggcatactgcgggatcagcgactggaacatcggcgatttcagcagattaccgagcatcagcgagtgcacggtaatgccgtactccgccagatccagcgccagcgactgcgttaaccccacgccgccgaacttggcggcgctgtagccggaattgtgtttgctgcccactttgccggatttcgagttgatctggatgatacgcccggcgatgccgtcgcggatcatcagccgtgaaaactcccgcgcacagaggaaatagcccaccagattcacctgcaacgagcggtcaaaatcccccagctcgacgtcgctgataaaggccgctttggcgatcccggcgctgtataccagcaaatcgacgcggccaaaaatctcgtccacgcctcgggagagcgccagcacgctctgttcgctggtggcgtctgccccgaaaccgtacgccttaccttcgccgaattcggcattgatctgctgtgcggtgctggcggctttatcgctctgaatatccaccaccgccacccgataaccctctgcggccagcccacggcacaggaacgcccctaaggtctgtcctccgccaatgacaacggcaacctgatccatacttttctcctcaactacgcagtaaattttaaaatgcagcccggctggatcgccgatggcaccggcccggcgacgtgcaccgtaccggggaattccgcctcgcgttctccgtcaaaccgcagggtgatatgacccagctcgcgcaggttttcgcccgccaccgcccccacggcggtgacgggatagcgctgttcccccagctcgaataccgcgccgggttgcaggctgccgtgcatttcgccgtggcagtgaataaagcagaacgcctgaatgtcggccggcgcgccctcgcgaaaggtgatcagcatcttttcgtccagcgcctccgctgcgctgtcgccaatatgggtgatggtggtctggtagatcacggacatcgtttatgacctcttattgatagatgaaacctgaaacaaaccaggcgataaggacggtaggcgcgccggtgagaaaacggctgaccagtacagaaggaacgccgacgcgcaccgtgtcctgacgcgcttccgccagtgacagccccacaggaatgaagtcgcacgccgcctgggcgttaatcgcaaacagggcgggcagggcgagatgcggcgggatgtgcccgaggccaatctgtacgccgatcagtacgccaatcacctgggcgatgaccgcgccagggccgaggaagggcgacagcagcgggaaggagcagatcagcgccagcgtcaccagccccagcggatggctggcgagcggggcgaggccgtgggcgatccagtcgcccagaccggatgccatgatgatgccgatcagcgccgcaacgaacgccataaacggcaggatggttttcagcaccgtatcaatggtgtcgcgcccggcctgaaagagtaccgccaccgccgagcccatccccatgccgaccttcgccagcaggccgtcgctctgctcggtgatcttcttactggtgtcgtaatcccgcggcgcaggatttgccgtggcggcctgttcgtggcgaatgttttcctctttcacgccggagacgtaaatgtcttcggtgatgtactgcgccagcgggccggacttgccggtggcatgaatattcaccgtcggaatacggcgtttcgggtagatcccacagcgcagggtgccgccgcagtcgatcaccgccacgccgatctctgcttccgcaggttctccctctttgaagccgtccaccgcctgccagccggtaagctgcgccagcttgtcgacgatggccgggcgcgttccggccgtgatatagacgatttttttcggcgtggtggcgtcaatcgtcagcgggccgccccagccgccggtgcccttttcaatcacaatgcgcgtcatgatgttgctcctgccaggcggactttctgctccagttgaatgcccatttttttctcaaaaatggcggtggtgaggtcagtgacccagccgcgaaagaagttggtgacgaggccgaccagcaggtagctcaccgccagcgggccgaggggtaaacccagcgtagtgaggccgctggcgatgcccagatacacaaacagctcgccgggattaatgtgcgggaacaggccgttcatcgagtggcagctataggacgcggcggcgtaatagctcggcttgtatttttccggcataaaacggcccaggctgagcgtcatcggattacagaacacaaaagtgccgaccagcggcagcagcagatagcgggtaacgggattaccggcgcagccctgcgccagtcgttcgatgcgttgctgaccaataaagttaatcagcgcgttcatgatcaccagcagactgatcagcaacggcagaatgcccgtcaccatgccggtaaatacttcgccacctttctgaaacagcccgataaaccactcggcgccgtgcgtgatggtttcgatcattcttttctcctccagggtagggtcttttgcacggctaataataatcactttgaaaggtttgaaagtgttattcatatctcattatgaaagataaaatgatcgaaatgaaagattttaaggaaaagaaggggagtaaacgttcgttttgcaagatttaggcggggcgcaggagaatgttgcggcgacttctctttgccgcttccttgtggacaggcagatgctttaccataattccctctcgccgaattcgttatcttatatggatgtcccatgtttaagcgtcgttacgcagctcttttacctgtgctggttctgctctccgcctgtagcagtaaaccaaaatccactcaggctcctgccactgcgggcacgccgccttccggcggattcctgctggagccgcagcatactatgctcaatccggccggcgattttgccaacaacccggcggctgaacagttcatcaatatgatggtcagcaaacacggttttgaccgtcagcaactgcatgagatcctctcgcaggcgaagcgccttgattccgtgctgcgcctgatggatcgccaggcgccgaccgccagcgtaccctcagggccaaccggtgcctggctgcgttaccgtaaacagttcatcacgccggataacgtgcaaaacggcgtagccttctgggatcaatatgaagatgcgctcaatcgcgcgtggcaggtgtacggcgtgccgccggaaatcatcgtcggcatcatcggcgtggaaacccgctggggccgcgtgatggggaaaacccgcattctggatgcgctggcaaccctgtcattcgcctatccgcgccgcgccgcctatttctcttccgagctggaaaccttcctgctgatggcgcgcgatgagagcgacgatccgctcgatttgaaaggttcttttgccggggcgatgggctacggacagtttatgccgtcctcctataaagagtatgccgttgattttaatggcgacgggcatatcaacctgtgggatccggtggatgctatcggcagcgtggccaactacttcaaagagcatggctgggtgaaaggcgatctggtggcagtaccggccatcgggcaggcgccggggctggcgaacggcttcaaaaccaaatacagcgttgcgcagctggcggcggcgggcttaacgccgcagcaatcgctgggtaatcatcaggaagcgagcctgctgcgcctcgatgtgggcaccggctacgaatactggtacggtctgccgaacttctacgccataacccgctataaccacagcacccactatgcaatggcagtctggcagctcggtcagacggtggcgctgtcgcgcgttaagtaataacgataaaggccggcgtccgctggccttttttctgaagccccctcgtaaaatcgacttcccgcccccacctttattgagaagatgctatcttgtctgccatgtttttattcacttacgggagtcatgatgacagacagtgaattgatgcatctgagcgagcgtatcggacaggcgctcaaagcgcggggcgccacggtcaccaccgctgaatcctgcaccggcggctgggtggcgaaagtcatcaccgatattgcgggcagttccgcctggtttgaacgcggttttgtcacctatagtaacgaagcgaaagcgcagatgattggcgttaagcccgccacgctggaacagcatggcgcggtgagcgagccggtggtggttgagatggcgataggcgccattaaagccgcccgcgcggactatgcgatcgccatcagcggcattgccggaccggacggcggcacggctaccaagcccgtcggcaccgtgtggtttggctttgccagcgccgcaggcgaggggatcacccgctgtgaatgcttcagcggcgaccgcgaaaatgtgcgtcgtcaggccacggcttatgccctgcaaacgctatggcaacaatttctacaaaacacttgatactgtatgagcatacagtataattgccgcaacagttaagaattcccggttgagcaccacctgctttacccggcatgacaggagtaataatggctatcgacgaaaacaaacagaaagcgttggcggcagcactgggccagatcgaaaagcaattcggtaaaggctccatcatgcgcctgggtgaagaccgttccatggatgtggaaactatctccaccggttcgctttctctggatattgcactgggcgcaggcggtttgccgatgggccgtatcgtagaaatctacgggccggaatcctcaggtaaaacaaccttaacccttcaggttatcgcggcggcgcagcgtcagggtaaaacctgtgcgtttatcgatgctgaacatgcgctggatcctgtctacgcacgtaagctgggcgtggatattgataacctgctgtgttctcagccggataccggtgagcaggcgctggaaatctgtgacgcgctcgcgcgctcaggcgccgttgacgtgctggtggttgactcggttgcagcgctgaccccgaaagccgaaattgaaggcgaaatcggtgactctcacatgggcctcgcggcacgtatgatgagccaggcgatgcgtaaactggcgggtaaccttaagcagtccaatacgctgctgatcttcatcaaccagatccgtatgaaaatcggtgtgatgttcggtaacccggaaaccaccaccggcggtaacgcgctgaaattctacgcttccgtgcgtctcgacatccgccgtatcggcgcggtgaaagagggcgataacgtagtgggcagcgaaacccgcgtgaaggttgtgaagaacaagatcgccgcgccgttcaaacaggctgaattccagatcctctacggggaaggtattaacttctacggcgaactggttgacctgggcgtgaaagagaagttcatcgagaaagcaggtgcatggtacagctacaacggtgagaaaatcggtcagggtaaagcgaacgccactacctggctgaaagagaacccggaaacggcgaaggaaattgagaagaaagtgcgtgacgcgctgctcagtaatccggataccaagcctgacttcaccgttgatgacaacgatgaacacgcgaaagaaggcgacgaagatttctgataatcttatgtaaccgataaaaagggctgcttatgcagcccttttgctattccattcccagcaggtgtgctatgtctgattctgatactacgccccgtcgttccgcctatgcccggttactggatcgggcgatgcgtatcctcgcgatgcgcgatcacagtgaacaggaatttcgccgcaaactcaccgcgcccgttatgaccaaaaccgggccggagccggtggatgccagcgaagaagatatcaataacgtcgtcaactggtgctttgaaaaccgctaccttgatgacgatcgtttcgcccgccagtttattgccagccgcgggcgcaaaggttacggcccgtcgcgcatcagccaggagctaaaccagaaaggcattggccgggaagccgcgcaggcggcgatgcgcgagtgtgatattgactggacggcgctggctcgcgagcaggcctaccgcaaatatggcgagccgctgcccaccgccttcgccgataaagtgaaagtacagcgatttctgatgtaccgcggctttatgatggaagatattcaggcgctgtggcgaaattttgatgattgactgcatacgggattttacttcgcagtaaagaaaacttatcttattcccactttttccggtagttggcggcggtctctacgcagtcaaccgccggctacgataatacgttagcttgatttcaggataattatgagcaagagcaccgctgagatccgtcaggcgtttctcgactttttccatagtaagggccatcaggtagttgccagcagctccctggttccaaataacgacccgactctgctgtttaccaacgccgggatgaaccagttcaaggatgtattccttggtctcgacaagcgtaattattcccgcgcgaccacctcgcagcgctgcgtgcgtgcgggcggtaaacacaatgacctggaaaacgtcggttacaccgcgcgtcaccataccttcttcgaaatgctgggtaacttcagcttcggcgattacttcaaacacgaagccattcagttcgcatgggaactgctgaccggtgaaaactggtttgccctgccgaaagagcgtttgtgggtaaccgtgtatgccactgacgacgaagcgtacgacatctgggaaaaagaagtcggcattccgcgcgaacgtatcatccgtatcggtgataacaaaggcgcgccatacgcttccgacaacttctggcagatgggtgacaccggtccgtgcggcccgtgcaccgagattttctacgatcatggcgatcacatctggggcgggcctccgggtagcccggaagaagacggcgaccgctacattgagatctggaacatcgtctttatgcagttcaaccgccaggccgacggcaccatggaaccgctgccgaagccgtccgtggataccggtatgggccttgagcgtattgccgccgtactgcaacatgtgaactctaactacgatatcgatctgttcagcaaacttatcgaagccgtagcgaaagtgacgggcgcgacggatctgagcaacaaatccctgcgcgtcattgccgaccatattcgttcctgtgccttcctgattgcggatggcgtgctgccgtcgaatgaaaaccgtggctacgtgctgcgtcgcatcattcgtcgcgcggtgcgtcatggcaacatgctgggcgcgaaagacaccttcttctacaaactcgtcggtccgctgatcgcggtgatgggcgcggcaggcgaagatctgcaacgccagcaggcgcaggttgagcaggtgctgaaaaccgaagaagagcagtttgcccgcacgctggagcgtggcctggcgctgctggatgaagagctgtcgaagctgaccggcgatacgctggacggtgaaaccgccttccgtctgtacgatacctacggtttcccggtggatctgaccgccgacgtgtgccgtgagcgtaatctgaaagtggacgaagcgggcttcgaagccgcaatggaagagcagcgccgtcgcgcgcgtgaatccagcggttttggcgccgattacaatgcgatgatccgcgttgacggcagtaccgaattcaaaggctacgaccaccttgagctgaccgcaaaagtcaccgcgctctttgtcgacggtaaagcggtagacgccatcacagccggtcaggatgcggtggtggtgctggatgaaacgcctttctacgccgaatccggcggtcaggtgggcgataagggcgagctgaaaggcaatggcttcacctttaccgttaccgacacgcagaaatacgctcaggcgattggtcaccagggcaaactggcgtccggcgtgctgaagctgggcgatggcgtaaaagcggaagttgacgaggctcgccgcgaacgtattcgtctgaaccactccgccacgcacctgatgcacgccgcgctgcgcgaagtgctgggtacgcatgtggcgcagaaaggttctctggttaacgacaagatcctgcgctttgacttctcgcatttcgaagcgatgaaaccgtcagagatccgtgcggttgaagatctggtaaacgcgcaaatccgccgcaacctgccgatcgaaaccaatatcatggaactggaagccgcacgcgcgaagggtgcaatggcgctgttcggtgagaaatatgatgatcgtgtgcgcgtgctgagcatgggcgatttctcaacggagctgtgcggcgggactcacgcctcacgtaccggtgacattggcctgttccgtattgtgtcggaatcgggcaccgccgctggcgtgcgtcgtatcgaagccgtcaccggcgaaggggcgattgccagcctgcatgcggaaagcgatcagctgcatgacatcgcgcagttgctgaaaggcgacagccagaacctgggcgagaaagtgcgcagcgttctggataaaacgcgtcagcttgagaaagagctgcaacacctgaaagaacaacaggcagccctggagagcgcaagcttgtccagcaaagccgaagacatcaatggcgtgaagctgctggtcagtgaactggcaggcgttgagccgaagatgctgcgtaccatggtcgacgatctgaagaatcagttaggttctactataatcgtgctggctacggtggcagagggtaaggtttctctgattgcgggtgtgtctaaggatgtgaccgaccgcgtgaaagcaggggaactggtaggaatggtagcccaacaagtggggggcaaagggggcggtcgaccggatatggcgcaagccggcggtaccgatgcgtcagcgcttcccgcagcactggccagcgttaaaacctgggtaagtgcgaagctgtaaataacgaaaaagcgcaggcaaatgccatgactcaggttgtggcatttttgtcactacgcttttgataacgataaagtcaggttgaagttgtgtatatcggctaaacttacgtttaacagaaagtaatagtggtgatagctgtcgcttcagatactggtcatcacatacttttttgacgtttatgatggataatgccgggatacagagagacccgactcttttaatctttcaaggagcaaagaatgctgattctgactcgtcgagttggtgagaccctcatgataggggatgaggtcactgtgactgttttaggcgttaagggcaaccaggtacgtattggggtcaatgctcctaaagaagtgtccgttcaccgtgaagaaatctaccagcgtatccaggctgaaaaatcccagcagtccagctattgatattatcgcgtctcgccccccggcgaggcgcggttcattcccgctattttcctcctctttcgtgacactatcatttccttttaatttccctgtgcatccgcacgtgcaaattctttggctattctgcgcttttttatcaccatggggctgaaccgcctccgccagctaccgcggccgcgcctgctaaaatctgctgataaaacatcctttttgcgctttttgcagcctaattgtctgcgaagtgtgcaatcgattcagggctgggaaaaattgtttgacttataagtcccagaaagtaatatgtgcgccacgcagcgacgatgagcagaaacaagttcttcgaagcactcgtaagaggcgtgtggtgaggtggccgagaggctgaaggcgctcccctgctaagggagtatgcggtcaaaagctgcatccggggttcgaatccccgcctcaccgccattttgcatccgtagctcagctggatagagtactcggctacgaaccgagcggtcggaggttcgaatcctcccggatgcaccattctccctcaggataacagcgaaagcggctgtcaaagagcgtgcgatgttatcgcaagcaccagggaggataacgttgctttagcaacggcccgtagggcgaggcgcagccgagtaatcctcccggatgcaccattctcctctggttgtttcagtaacaatcagcgcagtaaagcaatacctgatgcatccgtagctcagctggatagagtactcggctacgaaccgagcggtcggaggttcgaatcctcccggatgcaccatctcttttgattgtttcagtaacagtcaatgcagtaccttagtaattcccgatgcatccgtagctcagctggatagagtactcggctacgaaccgagcggtcggaggttcgaatcctcccggatgcaccattctccttcaggataacagcgaaagcggctgttaaagagcgtgcgatgttatcgcaagcaccagggaggataacgttgctttagcaacggcccgcagggcgaggcgcagccgagtaatcctcccggatgcaccattctcctctggttgtttcagtaacaatcagcgcagtacagcaattcccgatgcatccgtagctcagctggatagagtactcggctacgaaccgagcggtcggaggttcgaatcctcccggatgcaccatacttccccggtctttcagcaacagcgattcatgaaagaatctgcaatgctgttacaagcaccagggaggataacgttgcttcagcaacggcccgcagggcaaggcgcagccgagtaatcctcccggatgcaccattcttcgtacctcctcccaaatccaaaattcccgatattctccttgcgctgccagcgacaaaaatccttgtttacgttacagtatccttctgttatccggttgtgagaacgcgatgtacgaacgttacagtggactaatttttgatatggatggcaccatcctggatactgaacctacgcaccgtaaagcctgggatgacgtcctagggcgctatggtctgcgctatgatttgcaggcgatgattgcccttaatggctcaccgacctggcgtatcgcgcaatctgttatcgaatacaatcaggccgatctggatccgcatctgctggcgcaggaaaaaaccgccgccgtgaagtctatgctgctcgatggcgtgcgtccgttaccgctggtagaagtggtgaaagcgtggcacggtcgtcgcccgatgtctgtcggcaccggcagtgaaagcgccattgccgaagcgctgcttgcgcatctgggcctgcgccactatttcaccgccgtggtcgccgccgatcatgtgactcaccataaacccgctcccgatacctttttacgctgcgccgagctgatgggcgtgccgcccgccgagtgcgtggtgtttgaagacgcggatttcggccttcaggcggcacgcgcagctggcatggacgtcgtggacgtgcgcgtattgtgagtgacggcctgtcactcttctcattgtttgccggcagttttctcagcgccacgttattaccgggcaattctgaggtgctgctggtcgccttacttctttctggcgtgagtcagccctggctgctggtattaatagcaacaatgggtaatagccttggagggctgactaacgttatccttggtcgcttctttccgctgcgtaaaacgtcacgctggcaggaaaaagccacaggttttctcaatcgttatggcgcagccgcgctattattgagctggatgcctgttattggtgatttgctgtgcctgctggcgggatggatgcgcatctcgtgggggccagttctcttttttttatgccttggcaaggcgttgcgctatgttgttgtggcattcgcaacgcttcagggcatgacgtggtggcactaattgcattgctggccttaaatcgtcaaccattacaattatgctgtgtagaaatgatttcgacaggcgggaggtcaatttgatcccggacgtatcacaggcgctgtcctggctggaaaaccaccctcaggctttgaaggggatccagcgcgggctggagcgcgaaacgctgcgcgttaatgcagatggcagtctggcaacaaccggacatccggagcagctcggttcagcgctgacacataaatggatcacgaccgatttcgcggaagcgctgctggagtttattactccggtcgacggcgatattgatcatatgctgacgatcatgcgcgatgtgcatcgctataccgtgcgtcagctgggcgacgagcggttatggccgctgagtatgccctgttacatcgagaacggtcaggacattgagctggcgcagtacggcccctcaaatattggtcgcctgaagacgctttaccgtgaagggttgaaaaaccgttacggcgcgctgatgcagaccatttccggcgtgcactataacttctcgctgccgatggccttctggcaggcaaaatgcggtgaaacggataaagaagcgatctcggcagggtatttccgtctgatccgcaactactaccgtttcggctgggtgatcccgtacctgtttggcgcgtcgccggcaatttgcccgtcgttcctgcagggcaagccgacctcgctgccgttcgagaaaacggaaaacggcatgtactatctgccgtatgccacctcgctgcgcttaagcgaccttggctacaccaataagtcgcagagcaacctcggcatcacctttaacgagctgaacgagtacgtggcggcgctgaaacgggcgattaaaaccccgtctgaagaatacgcgaagctgggcctgacgaaagacggcaagcatctgcaaatcaacaccaatatcctgcagattgaaaacgagctgtacgcgcctatccgtccgaaacgcgtaacgcgcagcggcgaaacgccgtcggatgcgttactgcgcggcggcattgagtacattgaagtgcgctcgctggacatcaacccgttctcacccattggcgttgatgagcagcaggtacgcttcctcgacctgtttatggtctggtgcgcgctggcggatgcgccggagatgagcagcgacgaactgctgtgcacgcgcaccaactggaaccgcgtgatccttgaagggcgtaagcctggcctgacgctgggtatcggctgtgaaacggcacaatatccgctggcgaaagtgggcaaagatttattccaggatctgaaacgcgtcgcgcaaactctcgatggtattgacggcggtgatgcgtatgcgaaagtatgtgatgaactggtggccagctttgacgatcctgaactgactttctcggcgcgcattctgcgctcgatgattgataacgggattggcggcaccggcaaatcactggcggcgcaatatcgcgatatgctgcgtgaagaaccgctggaaattctgaaagaagaagatttcagcaaagagcacgatgcgtcatgggcgcggcagcgggaagtggaagcggcggataccgagtcgtttgaagagctgctggcaagacacgcctgacagaaaagaaaaaggccacatttctgtggccaaatattcatctctgaaaacagggatgatgataacaaatgcgcgtctttcatatattcagactcgcggttgttcgaagagttcagtttatttttaaaaaaatcactccggaggtgacaagatgccattgttggatagcttcacagtcgatcatacccgtatggaagcgcctgctgtgcgcgttgccaagaccatgaacacgccgcatggcgacaccattaccgttttcgatctgcgtttctgcattccgaaccaggaagtgatgccggaaaagggcattcatacgctcgagcacctgttcgccggtttcatgcgcgatcatctgaacggcaacggcgttgagatcatcgacatttccccgatgggctgccgcaccggtttctatatgagcctgatcggtacgccggacgagcagcgtgtggcggatgcctggaaagcggcgatggcggacgtgctgaaggtgaaagagcagaaccagatcccggaactgaacgtctaccagtgtggcacctatcagatgcactcgctggacgaagcgcaggagatcgcgcgtcatattctggatcgcgacgtgcgtgtgaacagcaacgacgaactggcgctgccgaaagaaaaactgcaggaactgcacatctagtttcggtcagtgaggtataaaaaaagccagttcagtgaactggcttttttatttgccggttttgccgggtggcgcttcgcttacccggcctacacctacaaagcgtaggcccggcaagcaacgcgccgccgggcaaaacgacacaatatcaatgcgcgccgccaccaccacccgcgccgaacggcggtctggcgaaccacaccagccccagcagcagaaggaagatcccggcggagatccagaaaatctcattggccgaaatgatcagcccctgattggtgatctgctgggcgatccacccggacgcctgctgctgcgacatgcccattccctcaagctgcccgtagatttgctcagtattcgcgttataaggattcaccgactcggtcagctgcgcatgatgcatcgactcacggctggtccatagcgtcgtggtaatcgacgtaccaatcgagcctgccagcgtgcgcgtaaagttcgacagactcgacgccgccgccagtcgttcaggcggcagaccggagagcgtaatggtcgtcagcggcataaagaagcaggcgacggcgaagccctgaataaactgcggccacgcggacgcgccaaagtccatgcccggctcaaaggtataggcgcgccagtagaagcacaccgcatacataatgaagctgaaggtcaccagacgacgcatatccagcttatgagcaaagcggccgataatcggcgacaggatcaccgggataatgccgaccggcgcggacgccagccccgcccaggttgccgtgtagccgtatacctcctgcaacagctgcggcagcaacacaatagcgccgaagtagagcatataggcaaggctgatacacaaacagccgatggtaaagttgcgcgacttgaacagcgaaagatcgacaatcggatggtcatccgtcagctcccagacaatcaggaaggagagggagaccaccgcaaccaccgtcagcacgataatttcggtggagttgaaccagtccagctctttaccctgatcgagcatcacctgcaaactgccgatgccgacgatcagcaatgccagcccgacgccgtcaatgcgccgctgctcggtacgggtttcgcgtccgcgcagcgcctgcgccgccatcagcaccaccaccagaccaataggcacgttgatgaagaagatccagccccagtgatagttatcgctgatatagccgccgaggatcggcccgcaaatcggtgcgacaatcaccgtcatcgaccagagcgccagcgccaccgaacgtttggcgggcgggtagttgctcagtaacagactctgcgacagcgggataaggggacctgcgacaataccctggatcacgcggaagaaaatcagcatgttcaggctgctcgacaccccgcacgcccaggaggcgatggcaaaggcgacggtggaccataaaaagagtcgcacctcgccgacgcgtttcgccagccagccggtgatcgggatggagatggcattcgccacgccaaacgaggtgatgacccaggtgccctggctcagtgacgcgcccaggttaccggcgatggtcgggatcgccacgttcgcaatggtggagtccagcacctgcatgaaggtcgcaagggacagcgcaatggtcatgatgaccagctgcgcgccctccagcggtttacgctgctgcatagcactcacctcaggattaacccgcgttggcctgaacgatgttattgatcagggtattcaccggctccaggctgatttcccgcgcattactttcatacgctggcgtactgcgcgcctggcttgccagcacctggccgtcgcggttggtggtatccaccgtcaccagcgaagaaagaccaatgcgcagcgggtgatcggcgagctgtttcgcatccagctcaatacgtaccggcagacgctgaaccactttgatccagttgccggtggcgttttgcgcgggcagcagcgagaaggcgctgccggtgcccatatccagaccgaccactttaccggtgtacttcacctcatcgccgtagaaatcgctgatcaccgtcgccgtctggccaatacgcatatgcgccagctgcgtctctttaaagttcgcgtccacccacagaccggttgccggtaccacagccatcagcgcggtggtcgggctgatttgcgcgccaggctgcacggcacggcgggaaacatagccggaaatcgggctgacgattttggtacgttgcagcgcaagccaggcgttacgcacttcagtggcggcctgttgcaccgccggctgatcttcaaggcgggtgccgaggatcatcgcctggttggcgttatattgctgcaccgccacatcaagctgcgcctgcgcgctggcgaccgcatcacgggagtgttgcagctcttcacggccaatcaggttggcgctgcccagcggtacacgacgattcaaatcgctctgcgcctgggcgagggcggtttttttcacttcgatgttagcctgatactgacggctgttgatcatcagctggcgggtctgacgcacgctggaagccagctgcgtctgcgctttttcaaatgcctgctgggcatccgtcggatcaagggtgaccagcacgtcgccctgtttcacataatcggtgttgtcatgccagactttcgtcacgctccccgacacctgcgccataatctgcacctggttgccagccacatacgcatcgtcggtttcttcgacgtgacgcagtaccatgaaccagtaaatcccgtatgccacagcaataataataaagagcaaggtcagaagaagcagggcacctttacgtttgcctttcttcctgaccggttgctgcggggtttgagtctccgcatttgcgctcatgtgtgttctccacgatctttttatatattcggcaacgccgacctgttcaccaaaaagccagcattaaaaatgctggcctggcggatttcttatttaatcaggatgtcagagctaatcgtcgcgttagcgcagcgcctcaagaatgacgtcttcttcgtccatctggtcgaggcggttcagtagcttacgggtgatttgctcaagctgttctttctcggcggggctcagagaagaccagagcaggtgcagacagttatgctgcgggggtaaaacctgacgcaaaaattcgtgacctttttcggtcaattgcagatgcagacaacgacggtcgttgtcgctctcacggcgttcgatccagccgcgtttttccagttcatcggcaatacgggtggcattggtgcgcgacgaacccagcgcacagctcagctcggaaggctgaatgctatgattttcctgcgactcaagggtaattaacgccatgaacaacgtttcgttgatcccctgcgctttcagcattttgttgcggttatccagcagtttgccctgcatatgcatacacaaacgcgtcagcagaatttcctgaaacggaaaatcttcataacgactggcacggaacttcagcatttgctcaatgggcgtgaacgaactttccatctcaatatgacctcattaattacagccgatatagtaacggcggtgacaaataatgtaaatgtattattttccttgagtgattagttttaagaatagtttcagccgggctgaagccgatcctggcgatggtagccgagccaccagaccagcagattcaacagcgccatcacgctgcctgccacacagacgcccgcccagcccgcatgctgccaggctgatgcagaaatcagcgagcctgccgcgccgccgataaagtagctggtcatatagcccgccgtcagacggttacgcgcgtccggcttcaccagatagatcactgtctggttggtgatatgcacgccctgcacggtcagatccagcaccaggataccgatgatcaacgcaatggcagaagtatgaccaaaccagatcgccacccaggagagcagcagcaacagtaaaccggtggtggtggtgatatgcgccttgcctttatccgccatgccgccggcaggccgcgcgcccagcgcgcccgccgccccggccaggccaaacaaaccgatcacgccttcggagtaattaaacggcggcgcggccagcagaaacgccattgaggtccagagaatgctgaaattggcgaaggtcagacagccgagcaccgcgcgggtacgcagcagcgaatcgcgggtgaacagagaaaatatcgagccgagaagctgaaagtagttgagatgattatcctgcttcactttcggcagcccgcgccacagcgccagcgccatgaccagcattaacgcgctcgccgcccagtagacggtgcgccagccgccaactcccgccagcaggccggaaacggtacgcgccagcagaatgcccagcagcaacccgctcatgatagtgccgaccactttgccgcgcttttccggcgaggcgagggtggcggccagcggcaccaggatctgcgccaccaccgagaacagcccggtcagcgctgtgccgaagatcatcatccacgccgaatggctggtggcggtgatcagcaggccgcaggtggagagcagcgtcatcagcacaatcagcgtccggcgttcaaacatatcgccgagcggcaccagaaacatcaggccgaccgcatagccgagctgcgcggcggtgacgataaatccggcctggttgggggtgagggaaaaggcgcgggcgatggtatcaagcagcggttgcgcatagtagttgctggcgacggcgagaccggtcgcgacggacatcagcacgatcagagccgggctgagggtgtgggtggaatttttcattattattgaagtcgttagttgagtggttttcttgccagaattcaatgataacgaattgggggattgttggggaattgttacgtgtccgaacgtgcggttaaagatgcccctctcacagcaggagaggggtacctgaatattacttctgcgctgccagcgcttctttcacccagccgtcaaactgctgctggtgggctttgatccagccatcgacatgaccgttaatatcggcttctgaggctttaccggcatgcatcatcgcgttctgcgcgttaatgtcagccagcggcagtttcatcaccgagaacagcttcgccgccgccgggtttttttccgcccaggctttgttcgccacaatgtgcatcgtgttaaccgggaagccgtagttcatgccgttcggcagtttagtatcaatatttttctgctcgcccggcagggaggagaacggcacctgcaaccacaccacgtctttacccggtttcagcacgtcgctcacccagtacggcgtccaggtgtaatagagcaccggcttaccttctttaaagcgtgcaatggtatccgccatcatcgccgagtagttaccgtggttcacggtcacggtatccgccagcttataggcctcgttctggtggttgatcaccgcctcgcagccccagcctggcgtgcagcccatcatgtcggctttaccgtcgccattgctgtcgaacagcttcgcgatcttcggatctttcagctgttcaatattggtgatgtgatatttttcagcggtttttttgtcgatcagataaccctgggccgcgccggtaacaaacaccccttcgcggtaaaacttcttatcgccgcccgctgcggcatacatatcgtcatgcagcggctgccagttaacggcggtaaaggtggcatcaccggaggcaatggaggtatagccaacgttgtaatccacttcgctcggcttattcacggtgtagccgagcttttccagcgcgcggctgaccagctgcgtctggaagctttcttcggagatggtgctctggatcggttgtacggtaatgcctttacccggcagatcggcggcgaaagcgctggtggagataaggctggcaaacgctgtggcaatgattacattctgtcgcatcgttgttcctcaagctaaacattagtcaggcccggcaggcgtagcgccgccgggcaacaggatcacttactgaacggacgggtcagcagacccagcgggccggtctgataccagcggcggttgccacgactgcgggagtcgcgacccacggcctgggtcagacggtcaagaataatggcgaggatgacgatcccgacgccgccgacggtggccaggcccatatcaagacgaccgataccgcgcagcaccatctgacccaacccgccaacggcgatcatcgaggcgatcaccaccatggaaagggccagcatcagcgtctggttcacgcccgccataatggtgggcatcgccagcggtagctgaactttgaacagcatctgccgcgggctggcgccgaaagagcgcgaagcttcgatcagatccgccggtacctggttaatgccgaggattgtcagacgcacaatcggcggcagggcgaagataatggtcaccaccacgccgggcacgttaccgataccgaacagcatgacgataggcaccagatacacgaacgccggtgtggtctgcatggcgtccagcagcgggcgaatgatcttcgccgcccgctgactgcgcgccagccagatccccagcggcaggccgatgatcatgcagaacagcagcgcggtcagcaccagcgccagggtgatcatcgcctgcgaccaggcgccgatagcgccgatggcaactaatgaaatcagcgtcgccacgcccatgctgaggctcgacatctgccaggcgatcagcgcgaaaataacaatcgccaccggcgcaggcatacccagcagcaattgctggaaggcgctgaggatataatccaccggcacgcgaatgccctggaacagcgggcggaaatgcaccaccacccagtcgataccctgcgtcacccagctgtcgagtgggatcagcgacttatggaagggatccataatattgaaatgctccggcgcaggcggcgcgctggaaagccagtctgtaccgccgccatcggctggcgcccctgacgggctgccccatgcatctgcggactgtgcggcgctgtcggcagccggttcgctgccccacggattagattgatcagccattgttcaccccatcgcgatctaaagccctgagcagcgcacctttggagatgctgcccatatactgttgctcctcacccactaccggtacggcgcagggcgcctgtccgacaagggagagcagttcgctgagcggcgtttcggcttccaccgcagcgggggactccagtaacgccgcatcgatacccagattctggctcagcgccgttttcagggaatcaacagagacaatgccgacaaatttatttccgcgctcgatgacgtaaccgtaatcacgatcttcatcctgcaataatttcagcgccgagcgcgggccgaaaccaggcgttttacggatcagacccgcctgagtacgacgggcaatatctttggcgctgaacacctgactaatatccacgccgcggaagaaggtgcggacataatcattggccggattattgagaatttcatcgggcgtaccgacctgcaccactttgccattttgcataatggcaatgcgatcgccgatacgcatggcttcatccagatcgtgggaaataaagacaatggtacgctgatgtttcgcctgtaattttaccagctcatcctgcatttccgtgcggataagcggatcgagcgctgagaaggcctcgtccattaataaaatatcaggattaatggctaatgcgcgcgccagaccgacacgctgacgcataccgccagagagttcatccggatacgaatgggcataattttccagccccacctgacgcaacgcgtccagcgctttggtctggcgttcagcggcgggcacgcccgctaattccataccgaaggcggtattatccagtaccgtcatatgcggcatcagcgcaaatgactggaagaccatcgcgatctttttcctgcgcacctcgcggagtgcggcgtctgatattttggcgatgtcttcgccgtcaatcagcacctgcccgcgggtgggttcaatcaggcgattgagaaggcgaaccatggtcgatttacctgaaccagataatcccatgatgacgaaaatctcgccttcttcaatggccagactggcgtcaatgacgccaagcgatagccctgttttttccagtatctgttctttcgaaaatcctttttcgatatatttgaaagctcgctgtggatgctcaccaaatattttatagagatttttaatttcgagtttaattgccatgcaataaatgagttcccgttatttatttatatcaatacagttcctgatggaaataatgagcgggctataccctaacatactcagattctgtgacaaccctcaaatgccagctggcacggaaattgccgaagcgcatctggcggcatttcccatgatataagggctgagagcgagtcttacaaagtgatattttttttgaaaagcacgtgaaatggtacctgaaacgggaagcttcaggtgaaaggaattagttgggagcagtgtagttcacagggaaatattcgtgtgatgaaaacggaaatattatgaaatatccatccgggaaatacggaaatatttcccggagaggagaggattaaaaatcccagtcttcgtcggtggtttccaccgctttacccatcacataagacgagcctgaaccggagaaaaagtcatggttttcatcgccgttgggcgacagcgccgcaaggatcgccggattcacatcagccatttccggcgggaacaatgcttcatagccgaggttcatcagcgccttgttagcgttgtaacaaagaaaagcctgcacatccgcttcaaggccggtgccgccgtataaatccgcggtataggccagctcgttgtcgtagagatccatcagcagatccagcgcaaaaagctttaacgactcgcgctctgtttcgtcgactttttcgaggcccttctggtatttataaccgatgtaataaccgtgtaccgcttcgtcacggataatcagccggataagatcggcggtattggtcagcttgccgcggctggaaaaatacatcggcagccagaagccggaataaaacaggaaggattccagaaagacgctggcgattttcttcttcagcggcgcatcggcggcgtactgctcgaggatcagctgtgctttgcgttgcagcggcgcgttttcctcgctccaggcataggcggcatcgacatctttggtctgacacagcgtcgagaaaatcgagctgtaagagcgggcatgtaccgcctccataaagctgacgttcgacaacaccgcctcttcatggggcgtcagcgcatccgccatcagcgccggcgcgcccacggtattctggatggtatcgagcagcgtcaggccggtaaacacgcggatggtaagctgctgctcggcctggttcagcgtctgccaggcgggaatgtcgttagacaacggcactttctccggcagccagaaattgctggtcaggcggttccacacttccagatctttatcgtcctggatcttgttccagttaaccgcactgacgcgggataaacggctcatccttttctccttacagcgcgcatgacacgcagccttcaatttcggtgccttccagcgccagctggcgcaggcggatgtaatacagcgtcttgatgcctttcttccacgcataaatctgtgcgcgattgatgtcgcgcgtggtggcggtatccgggaagaacagcgtcagcgacagcccctgatcgacatggcgcgtggcggcggcgtaggtatcaataattttttccggcccgatctcgtaggcatcctgatacatcgccagattgtcattggtcataaagggggcagggtagtacacgcgcccggttttaccctctttgcggatctcgattttcgacacaatcgggtgaatgctggaggtggcatggttgatataggagatcgatccggtcggcggcaccgcctgcaaattttgattgtagataccgtggcgcatcacatcgtcgcgcaactgctgccacatggcgcgcgtcggcagcacaatgcccgcgcgggcaaagagtgtgcgcactttttcggttttcggctgccactcttcttccagatagggcgtgaagtattcgccgctggcgtagcgggagcgctcaaatccggcaaaacgctggccacgctcgcgggcgatcatcattgaggtatgcagcgcgtgccaggtgatggtgtaaaaatagagattggtgaaatcaatgccttcttcgctgccatagagtatgccttcccgcgccagataaccgtgcaggttcatctgcccgaggccgatggcgtgggatgcggcattgccgttttcaatggatggcaccgagcggatatggctcatgtccgacaccgccgtcagaccgcgcaccgccgtttccaccgtgcggccaaaatcaggggagtccatggtatgggcgatgttaagcgagcccagattgcaggagatatcccgcccggtctgcgcgtaatccaggttttcatcgtattccgacgcgctgttgacctgcaaaatctccgagcacagattgctcatgttgatgcgcccggcaatcgggttggcgcggttaaccgtgtcttcatacatgatgtacgggtaaccggactcgaattggatctccgccagcagctggaaaaaatcgcgcgcgttgatgtacgttttacgaatacgatcgtcggccaccatctcatggtagtgctcgctgatcgccacatccccgaacggcttgccgtaaatacgcgctacgtcatagggagaaaacagcgccatctgcgcattgtctttcgccagctggaaggtgatatccgggatcaccacgcctagggaaagggttttaatacgaattttttcgtcggcgttttcccgtttggtatccagaaaacgcagaatatccgggtgatgggcgtgcagatagaccgcccccgcgccctggcgcgcgccaagctgattggcataagagaacgcatcttccagcattttcatcaccggaataacgccggaggactggttttcaatgcgcttaatgggcgcgcctgcttcccgcaggttagagagcaaaaacgccacgccgccgccgcgtttggagagctggagcgcggaattcaccgcccggccaatcgactccatattgtcttcgatacgcagcaggaagcaggagaccagctcaccgcgctgcattttgccgcagttgagaaaagtcggcgttgcgggctggaagcgtccggcgaggatctcctgcgtcaactgctgcgcgagttgctcatcaccctgcgccagcgtcagcgccaccatcaccacccgatcctcaaagtgttccagatagcgtttgccgtcgaaggttttcagcgtgtagctggtgtaatacttccaggcgccaaggaaagtctggaaacgaaaaccgctggcgtgcgccgtctcaaacaggccgatcacgaaggcgcgatcgtagcgcgccagtacgctgtcatcgtaatagccctctgcaaccagataatccaggcggctgttctgatccgcaaaggtcacagtgttaggcagcacgtgggcggtatagaacgcgtccaccgcctgatgatctttttcaaactggatgcggcccgctttatcgtacagattcagcatggcgttcagcgcgtgatagtccgtggaggcctgcattacgcgttctgcggttgtcgttgccaaaattcgctcactccttttcgcacatttatgatgtcacgcggcgtacccatcagctcaaaacggtacagatgcggcacgctgcatttttgcgcgatgacatcccccgcacggccataagcctcgccaaaattgcggttaccggcggcgatcacgccgcggatcaaggcccggttatgcgcatcgtttaaaaagcggatcacctgacgcggcaccgcgcctgcggttccgccgccgccgtagctcggcaccaccaggatatagggctcgtctacctggatccgctcacgctcatccaggggaatacgcacagcgggcagtcccaggcgggtgataaagcggtgcgtattctccgagctgctggagaagtagacgagggtgctcatgcgctggcgacgcggggggcgctgcccagacggttaatcatatcggggcgaaagccggaccagcgggtgtcaccggcgatcactaccggcaactggcggaatcccagcgcgcgcagttcatctgccgcctccggcaccaggtccacattcaccaaatcgaacgccacgccacggctttccatggcgcgttttgtcgcatggcactgcacacagtcatttcgagtgtaaatagtaatgcgcatgattcgtatttccatctaagatagcgggacgacgcgaaaaatcgcgccgggttgtgtgtcacttgcttaaggaaatactagatgtagttataaagattatcaaccacacaatatccaggaatttttagatcaatttcatcccgctgaagaactcagcggggaagggatttttgtcgctaaattacatgcgcatagcgatggcgagacggttaaaggcattcatcaggctgatggcgaaggtcagatcgctgatttcctgagcgctaaaatgttccagcatgggctgataaacatcatcccccgcatgggtcgtggagatgtgcgtcagcgactccgcccagcccagcgcggctttttccttcgcgctgaaatgcgggctgatatgccagcctgccagtgcatcaagtttgctctggtcggtgccggttttacgcagcgctttgctgtgcatctccagacaaaacgcgcagccgttgatctgcgacacacgtaaataaaccagctccagcagcggtttgtcggtagcgctgcgctccagtgcctggctggtctgaatgaggccgttatatgcctccgggctgagttcggaatagggcaggcgtaaatcagtcatggtcatctcctcgtttagatggcgagaaggtagcactataatggtctgcaccagagagccatattttaactaaaaaagcagaccataatggacgcccgataccagcaaattgcccgtcttctgaaatcttccatcgcttccggcgagcttgctcccggcgcccggctaccgtcgagccgtaccttcgcccgggaaaacggcgtgtcgcgcgccaccgtagagcacgcttatgccgagctggtggcgcagggctggattgagcggcgcgggcaggcgggaagttttgtcagcgacaccgtgacgccgggcagcgctttacccgcggcgtccctgacggaggggacagataacattccgcagccgtttcagatggggttgcccgcactcgatctctttccgcgcgcgctctgggggcgactgatggggcggcggctgcgcacccagacgcgctttgatctggggccgggcgacgtggcgggagagcggctgttacgccaggctatcgtcgattacctgcgtttttcccgcagtattgactgtacccccgggcagatatttatcaccgccagctacgcgatgtcgatgacgctgatcctgcgcacgctcgccgctgccggcgacggcatgtgggtggaagatccgggctttcggctgatccgcccggtgatcgcccgtgagcaggtcaggctgttgccggtgccggtcgatgagaacggcatgaatatcgacgccgcccgggcattacatccgcaggcgcgtttcgtgttgctgacgccagcgcatcagagcccgctcggcgtggcgctctcgttgccgcgccgtcggcagttgctggactgggcggcgcaccgtgaggcgtggatcatcgaagacgattatgacagtgagtttcgctatcacggcaaaccgctgccgccgctgaaaagcctcgacgccccgcagcgggtgatctacgccgggaccttcagtaaatcgctgtttccggcgatccgtaccggctggatcgtggtgcctgcgccgcacgtagccgctttccgtcgccaggcggcgatgtatccctgtacggtgccagggctggttcaactgacgctggcggattttatctcgcagggtcatttctggcggcacctgaaaaacatgcgtcagcattatgcccggcggcgtgaatggctggaaagggcgcttaagcagcagggttttgacgtggcggcgcagcagggcggcattcagctggtgatcgcggttacggatgacgataagcaactggcggcacgggcaaatcaggccgggctggcggtgcaggcattaagcgcatggcagatagcggggggcgacagaagggggcttctgctctgttttactaatatttcatcggcggaaatggcggaacagctggcggaaaaactcagcaaggcaatacgccccgcgagcgcaactcacggggcagcaatggactagcgacgcatgctcaggagcgcgccgaggaaaatcccgaccgctgccgcagcacctacgctggaccatggtttttctttaacgaacgtatccgcgcaacccactacatcgcaggctgcctgtttcacacgggtacggccctgcagttttgcacgggtttcttttaacagcgcctgtgctttacgacgtgcgccatcggcatcatccttcacgtcactgccccaggacttaagtacgctttccaggctgtccgctaaacggctgacatcatcattgatatcctgaacgccttgatcaacatctctgcggttcggtctgctaaacatatgatcctcccttgttttcgttgtcatgatcagtgtagcgcacaaaatccacccttgaagcggatcgcgagatatgccgccctttatggacttttccgaaagcgctgctaatgctcattactgtaaggttgcgatgcagtaaatgatgacgaggaaaaaatatgtatttacgacccgatgaggtggcacgcgttcttgagaaagcgggatttacgatggatgtcgctacgaataaaacctacggttaccgtcgcggcgataattatgtgtacgtaaatcgcgaagcgcgaatgggacgtaccgccttaattattcatcccacgcttaaagagcgcagtttgtcccttgcggagcccgcctcggagatcaaaatgtgcgatcactatcagcatttcccgctctacctgggcggcgatgcgcaggagcattacggcattccccacggattcagttcgcggatggcgctggagcgttttctgtcagggctgtttggcgaatcggcataatgcgttttcttttcatgcttccaataaggtgaagactcaggaaaacacgaacctttaagataatgcagtgaccactatcgcaattgatcgttaacgctggtggtcagctttgtctcaccctcatagaaaaaatcgtggagattgtaccgctttcgatgccataaataacatcgggggaaagtgtttactatacctatgagaccagaatgtgcggtgttaaggaaactattaccgacatggctttcaacgtcgctggcgttcgagatatcgcaagggtgctgaaaatcagcatcattatcattacgtatcacgtattcaaataaagtgtctaaccagtaaaataatctgtatgtcctgctctgtgtacctctttgaaaacatcaagggtgccttcactcaaaaaaatagatgttccactaattgaaggtcttacaaatttgtaccggagcaaactacacttcggtgtttttttgtttcattcctgttaatagtggggcctgtgtgcagagattttagcgttggatgagtatttgccgctcgttctattgagtcattcattggttacttccaaaattaacccccttctttattaaatgtgattttaagcaagtttcgaaacgctgttaagcgtattttattgtttgatttatatttaaatatattcacgagatgaatgcaaaagggaatttatatttatgacagttaaatttcaccctctaaacttttctcctgtagcgttcccgcatatacaaaggaacggcttgcgcgtcatgcgtgcaggagaaatacatttagcccagcaattatatggccatagcatccattatgaaaaagtctggatccaccacggcagttttttgccttttgatatgcaggaaaaccacacggcaatgacgccgaccggggagatatggtttgaacaagagctttataaggatgatttttctagatcagatttatctttaaaacatatttttatgcatgagcttatgcatgtatggcaaaaagagcgaggtatgaatgttattatgcgaggtctgatttcaggtataactgactatcactacaagctagataaataccgtctttctgattactcaatggaacagcaagccagtattgtatctgattactggcttttaaagcacttcggattttctcgtaaatcagctcataatttacttgattacaatcctaaaatccctgcatgtaaactcttatctgaatacgaaagaataatgggaaggtttccaaattgaaaagtttattgctgctattttctttcatgctttcagcatgttgctgggagcatcaaattgccctgcatcccggtgatgcctctatcaatagaagttctatttgtatatcttcatcgggtgggaaaaacctttcaggatatgctttagacgcaagaacacttgataatcattatgccgagagagatttggtggtttcagaaacagtaaatgcacgaacgccatactgttttaaattaaatcttgattcctatatggagtatacgctttactacgaattagatgatgttaattacacggttccatttattactgatgattctcctgtcgtgtacacaaaggcctactccaattaataaggaaattaattatgtcattacccgcttatatgtttctgtacgacgaaaatggtgttttgatgcaggggacttgtgaagcacatggacgcgtcggggctaccgaagtttcaacttcacaatttggcgtttatcaggggatggataatttcactgggcgttttagtggttcacgtcagcatgaaccttttacattccgtaaagagatcgacaaattaactccgtttttgttcattgcagtttgccaaagcaaacgttttaaaaaagttgagtttaaatactatgaaacatcttcagccggtatagaggttgaaacattcaatgtaattatggatgaggtgggcatcagttcctataatttcggtcatgcttatgcccccggcgctattcagtcgaatatgagtgaaatcatagggttccgctcaacaaaaataacagtgcgttatttacctggtaacatttcatattcagactcctggtatagggaatagcaatatttatttactgatgttttccccggtttcttattgaatgtaaatgtagcgacgggcctgtgcctgtcgcctgccgtcaggctttcgcctggtagtaattactcactctgaacagacggcggcagtaatccaggaagtagccgtagaccgcgcccattagcatcgataccacgatattcgaacttaccgccgcggcgatctggtgccagtctgcacccaccgtcagcaaaatcgccacgtagaccggtgactgaaaggtgacataggccgcgatatccgccagatttttcatccagcccgccggggtataacgacgcgccatacgcataatcgcatcacggtacaggccgtagggccaggcaatcaggatgttaaccgggatggcgaccagtctggacgagagcgactgctcaaagctcatgcctgaaagaaatatctcaatcagcatgttcactaccgaacagtagaccaccatggcaaaggtgtcggccacggcgtgacgcaggcgtgactgcggagagaacatgctaaagctcctgtgaaatatattatcaggtcgttcgccggtgaaaccagcgtaatgaagggggatgtttagtgtggatagagtatatcgctaccatgaaacgcacaattagcgattaatttttatttaacgcgcttttgtcaataaaatactctgtgagcgggcgattttttcgcgctgcgttatattgcgcgggaggtcagaggaaagtgttgataaacaatgagttgaggagaatgcggtgagcgcgcccaccgcacatgcaaaagacgctgattaacagacgccgaaatcgccttcttctttatatggcgtgacgtcaaccgctttcagggtaaacttttcaccctgttcgtcgctggcgcgtacggcaacgatttgatcgtcatttacttcgatcactttcagttttgggccgcccatacgcggctgcaccagatcacctgctgaaaacataattgcactccttcatgaatagtatgactgcgtaaagcagagtaaaagcataagacgaaactggcgatacccgccacaatgactacgcttaaagagaaattgtctttttttacaataacctggattttgcttgcaagggagtagttatgggtttctggcgtattgttattaccatcatcctgccgccgcttggcgtgttactcgggaaaggcttaggcggagcctttattctgaatattatcctgacgctgctgggttatatccccggtctcattcatgcgttctgggtgcagtcgcgcaactaatctttccggcggacagggcctcctgcccgccactcctgcttaacgcttaaaaggtttcccagttcgcatcacctgcggcggcggttgccactgccgggcgtagcgtggttttcgctttcactacgggtgttaccgggcgacgcagtttgtcattcacctgaaagaccgccaccgcctgacgcagttgatccgcctgttcttccagtgccgccgctgcggtcgcggattcctgcaccagcgcggcgttctgctgcgtgacgctgtccatctgcgataccgcgaggctcacctgctcaataccgcgactctgttcatccgacgccgaggcgatctcgcccataatatcggtcacccgcgtaacggcattaacgatctctttcatggtttcacccgcttcggccacctgtgacgaaccggtatccacgcggctgacggatttttcgatcagcgccttgatctctttggcggcgctggcgctgcggctggccagcgtacggacttcacccgccaccaccgcaaatccgcgaccctgttcaccggcgcgcgccgcttctaccgccgcgttaagcgcaaggatattggtctggaaagcaataccgtcgatcacgctggtgatttgcacgatctgctgtgaactgtcggcaatatcgttcatggtgcgcaccacattggtgaccacctggccgccgcgatcggccgtttccgaggccgtccgggccagttgagcagcctgacgggcgttatcggtgttctgtttcaccgtggcggtcagctgctccatgctggcagcggtttcttccagcgacgccgcctgctgctcggtgcgcgaggacagatcattattaccggaggagatctctcccgcgccggtgtagatggaatccgagctgctgcgcaccgcgctgacggtggagaccagcgactgttgcatctcatgcaggcccgcagctaactggctcatttcgttacgcccgtcagcatcgatctggcgcgtcagatcgcccccggcaatggcgcgaatatgcgccagcatgtcctgcaaaggtttaagcaacatgtgttgcagacccagccagatcaccacaaagaccgcgagcatcaccagcaaaatggtgcccagcgtccactgcatctgggtaaaactgtgctgattctgcgcggctgcggctttcagcagaccattgttttccgcacgccactgggcaaacgcggcttccatttcatcctgcgcctgctgtgcatcaagattgccgtaggcttcataattattggctttcagatactggatcgacatctgcaacacatcgtgcatctgacgccagtttttctccatcagcgcggcgaccgccgcatcctgcccgctgatacgttcagtacgcttgtagctttcgaagtaaccttcagatttgctgagtgaatcgcccgccgtagtcagcagtttatcgatggccgccagcgaggccggatcgcgctgatttttcagaaaacggatcgcaacgcgggtcaaagtgacgcgggttttgacaagggtattcacactgtcgctaagattttcctgctgtgcgttcagtacgccatattgttgaaagttgctgcgatcattatcaaccgcagaatagaacaacccacccgtcaccacctgcaacatacagaaaatggcaagcgcgaagatgatcccggtgatgaccttaatatttttaagcatgacagccgtccgtaagtgatccgcaagtgcataagggttatcgacgacggcagggggatctttatgaacatttagttaacatgtgcataaaaattagccccggtggttataaccggggcgggggattattgaccggccttgcgcagctcaaccgcgcgggcgatagacggctccagcagacgggcgacggcggcgaacaccggcacgaccacggaattgccaaactgacgataggcctgggtgtcggataccggaatgcggaacgggcgtccgccgggggtttcaaagcccatcagtcgcgcgcattccaccggcgtcagtcgacgggggcggcgcgcctgattcgttggatcggcaaacgccgtttcgcccagcgcatgatcccagccgcgatcgacaaggatctccgagccatctttgtggtagcgggcagacaaagtacgcgtcaccacgtccgggcgcgtgggatccaccagcccgaagccaaaaccgttgcccttcgcctggtgctttttggcgtagcggtagagaaaatcccacagcttttccgacagcacatacttgctgtcgaccaccggatccagcagctcgccgaaggccggtcgctgcgccggataaaagcgtttgatatcgcgcagggtaaaattgttgtggatgttcaggtcgcggcggaatcccaccagcactatgcgctcgcggtgctggggtaaaaaatgtttgccgtcgatgattttcggatcgtccttgccgttcaccgccgcatcagcgacctcgtagcccagctcgtccagcgtctgcatgatcacgctgaaggttttgcccttgtcgtggcttttaaggtttttaacgttttcgagaacaaaaatcgccggttgtttggctttgatgatgcgcgccacgtcaaagaacagcgtgccctgcgcttcacattcaaaaccatgggcgcggcccagcgcattcttcttgctgacgcccgcgaggctgaaaggctggcaggggaagccggcgagcagcacatcatgatcgggaatggtgcggtcaatgtgcgcgtaggcctgcgcctcggtgacatccgggttatcgcttaaggtgacttcccggatgtcgctgttaaaggtatgcaccgcgtcgtcgttataccagttggctttataggtacgcaccgcgttcttgttccactcgctggtgaacacgcactgaccgccgatggcgtcaaaaccctgtctgatgccgccgataccggcaaataaatcgataaaacgaaacgcatagtcgggatgatgggcgggcggagagggcagcattttgcgcaataatgcttcttcgctggcggtgagggatttcggcgcgcacttgccgttcacccggcggttaagggtttcccggctccagtcgtttttgcccagcttgcgcagctgctcggccacatatttttgtccgtagatcgccagtaccttatccagcagcgctctgtcacgcgcctgttgatcctgctcttccgcctgcgccttcgccagcagatcctgagcaataacatcaaattccgacatagcatctccttggtttaatgtgtgaaaatatatcactcatttgacccagcgccttatttcatttgcgcagcactgctttttttgtcattgctatactctgatttcacccctctggtggccttaagggtactttgtgcgtattgcaactattaccaatgtcgcctacgtcgcgacggttattctgacgctcgcctccggcgtggcgctgtttatggcctccagcgccgatcgcacggagcgcaaagccgttgaacagcgctatgtgctggataaacttaccgaagagattgaaatcgaagccttcgccttaagcgaactggcgcgctcgatcgtcattaatcctgatgctgaggagatccagcagctgaaagccggattcgcgaaagagcgggagctggaaaaacatctggtcgccgtgaaagatgtcggcgcctcgccggatgagctgctgctgttacgggacgggatggtggtgctcaaagcgctggaggatgagcagcaggcggcgctggcagcagtggaacggggcgcggcggcggaagggatgaaaattgtcttcagcgccgattacgagcagcagctcgatcaggtgcggtatcgcttcgatcacttccggcagctgctggatcagcgggcgcaggtcgcgatcggcgaggcgaccaaaaaatcccagtggctgcgctcattatcagaaatcatggtcggcctcaccgcgctgctgtttctgtttgtgctgggctttattatcaagcaccgcattctgcgcccggtggtgacgctcagcgatgtggttaaccgtctcgcctctcaggattacgacgtcgaagcgccggtgctggcgcaggtggatgagatcggcgacatggcgcaggcaatccgcatcttccgtgagaacggcctggtccgccagcggctggagcgcgagcgcgatgccgactgggtgacgcgcaatctgctggcccgcatgacgcaacggctacagggctgcgactccagggacagcattctgaaggtgatcgccctgtttgtgccgcaaattatcccggatatgagcgggcggctgtatatgctcgatcggcgcgccaaccgtatggtgtgcatgaccagctggctgtcgccctccggtgacgacacgccctttaccccggatcactgctgggcgctcaaacgcgggcagcttcacagcccggcgcgggatacggtggatgtgccctgcgagcatttaacgcccgacgtcgctgacaaggcgatctgcgtgccgttaatcgcgcaaaacaatattatcggtctgctgaccttcgagaatcgtgcgccggagaaagagccgccttacacctatcttgaactgatcgccgaaaccctggccctgtcgctggctaaccagaagctgcgcgatacgctgaccgagcgggcgatgtacgactccctcaccgggctgcacaatcgttatcatctggaagaaaccctgcgaacgctgctggggcgcgccgaagcgaagaaaagcgtgctcagctgtctgatgatcgacatcgatcacttcaaacgcctcaatgatacttacgggcatgaggcgggggatcaggtactgcgcgagacggcgcgggtgatccagcatgccttaaacgagcgcggcatggcgtttcgctatggcggggaagagttcctggtcatcctgccggaaatgaacgaagcccaggcgcaaagcgtcgccagtaagctactgctggccatctcaacgcagccgatgatctacgagacgcaggacattggcccggtatccgtttccatcggcatcgccacctggccggtgcacgcccgcgccgataatttgatccgtaccgccgatctggcgctctatctcgcaaaagagcgtggccgcggacaaatcgtgatggcgaaaaaaggtgagtaggggcaggcggctattaccgggaattagctctcttttatgatgatgctctgctgtttatcgccgcccgctctccgttaggctaagggtaaattgatgacccagtgaacctgacatgacccagccgacaaaagagcaagtgattgatgcgtatcgtttgatccgcacggaacaaccctggaagtttgatgcctccgacctgtctcatcaccgcgtactgccctatgccacgcggtcgccctggttagatgatcctgagtttttaagcctctacgaaaaaattaaagggcatacgctggtcgatttgtatcgctgctatgaattatggctgctggcaaagcagaccggtaaagttgaaggcgtggtgctggaagtgggcgtctggcgcggcggcaccggcgcgatcctcgcacaggccaccaaagcgctgggtaaaaaagtctatcttgcagatacctttaccggcgtggtgaaagccggggagaaagacacgctgtataaaggcggtgaacatgcggatacgtcgctggcgatagttaacgcgcttatgtcgtcactggcgattgataatatccagattctcgaaggtattttcccggacgatacccagcatttactgccggagaatattgccctgctgcactgcgacgtggatgtgtattcttctacgaaggatattgttgactggtgtctgccgcgcatgaataccggcgcaatgctggtatttgatgattacggcttttttggctgcgaaggcgtcaccacgttctgcgatgaattaaaactgcgcaacgatcttattttcacgcacaacctgaacggtcacgcggtatttgtgaaaatctgaatacagtcgctggataatcaggcccaacggtagcgttgggcctgaaaagcgcgatcaatagagacgaagcgttaattacattttcctgtcggggcttttagcgggccgcatgcactgtaatccagcagcaggtagccttttcgctgcatgcaaatttctatcttcccgatacggtttttatgctgctccagactttcgccagaatgaacataattccggctaaaatcatccggcgcgatgtttttatccagcccgcagctgtagagatcccgtgtacgctgcgcgacgtcggtatgcccgagctggcccggtttctgaatggtatgcgcatacggaaaagaggtgtaattgctggaatccatatcacccaccacgcaaccggtgagcagagcgcagagtaacagcacggttttattcagcatggctaattacattttcctgtcggggctttcagcgggccgcacttatcgaagtcctgcaagatatagcctttgctttgcatacagctctcaagcttgctgattcgctttttgtgttcttcaagcgtttctccaggaagcatagaaccgcgactgaaatcatccggcgcaatatttttatccagcccgcagctgtagagatcccgcgtacgttgcgcgacgtcggtatgcccgagctggcccggtttctgaatagtatgcgcatagggcgggtggcgaaaattggatgaatcaagatccgccaccacgcaccctgtaagcatcagccctgcggcggccaggcatacaacatgccggatcgccattagtctgtgcataacccggtaggggctttcagcgggccacagtcatcaaaaccgtaaaccttatagcccttgcctttcatgcagctcagcactttattgcgtcgtgcattgaactgttcagacgtttcgcccggataagaaccgttcaggctccagtgcggatcgtcaagatccacttttgggttcacgccgcaggcatacagatcggttttgcgctgctgcacgttggtgcgcccggcggcgtcaggtttctggaacaatttaatccacggcacatagtcgtagttagaagagtccatatcggcgaccacacaaccagtcagcagacaacacaacagcagcaaaattttgggcattctgtctcctaattgcatttaccggtgggcgcttttaacggaccgcacttatcgaagtcctgcaagatatagcctttgctttgcatacagctttcaagcttgccgattcgcttagtatgctcctctgaggtttcgccgggacgaagctggttacgactaaaatcatccggcgcgatgtttttatccagcccgcaactgtagagatcctttgtacgctgcgcgacgttggtatgtccgagctggcccggtttctgaatagtatgcgcatagggcgggtggcggaaattggatgaatcaagatccgccaccacgcaacctgtaagcgctagcgctaatgccgctaccatgcctgtacgaaatatcattagtccaccttagtgagaggcattaaaaataaagtccagcagttcaggagaaaccacttcgctcatcgcgaatggtgcagccagcggaattgctaccacagtccatgtctcagcagcgcctttggtaaacgggctgcgatcgcgcgaggtattgccttcgttgtcatagaatcctggcagctgaccgccaattaaatcgtgtgttccggcaaatgactcaactatcgtatcccctatatcgcccaggaaggagcccggtttatattcgccgaaaggcaccaacaagccgcccgtggcctggaagccgcctgttggcccaaacagacttttagcttccgggctttcttccaggaatttttcaatagtagggtattggggcgttcctttataaacaaccataccgcgttcatcgcgttttaggacggtattattgttttcaacaaccgtctcgcagcgttcattgttatcaccgcaaatagcatccaggccgatccttaccccgcctgctttaataccgtcatacagtccgttactctcgccggaaacattggtataaatctttttaacgtcggtaataccgtcaaacagcagggaattattaattgtctcctcacgcatcttcgtcgctgcgagagagagtgtcccctgggtaatagctgcgtccggcgaaccggctaccacgcccaccagcgtttgcaggaagcgacgctgatactgaagcttatagacttccgccagcgcggcatcgcgtttttcgatatcgccagacttgattgccgcctgcaagtcagcgcgcgctgctgcctgcttaccatccagataagagttgatctggttgttggcattctccttgaaatcgcgcgtcactttcacctgcaggttcagctctttcaacaccttgtctttatcgaagttgtttgcaagcttgccggagttcgcggcggcggtttccgtggtgatgtcggttttgacgccttccacggcctgctgctggtcggcagggcgggtaagggtgatattgctggtgttgataccgctgcgagtgaccgagctttcactgtcgctgtcatgcccgataccaaagctgacgttcttatccagcgaggcataaccgtttgccggtacgtggtagccctcttcggtggtgacggttttgttgctctggcgggtagcatgatcgcccagacccagatcggtattcatgctcatagagccgccaatgccaaagccgttgccttcgtattcggaacggttattgatatcgctccagctcagggtgccggtgctgagctggtttctgcctgccagttcggcgctttcgctggaggtgatcagcccgcctttcaggtcggtatgatctttcacgttgatgttataaccgttttcacccgcaaagacgccggactgctcctgcaccgaggcgtaatcagcattgaccttcgactggctatagttgcccgacgcggagaaaccgtagccaaccgtgacctggccgcccatatctttctgctgaccgttgtagcgcgaggtgtcctggaggctttcgatattcaggttttccgccgtaatatccacgcctttgcccagcacctggccgccgcgcagcgtggtggtgccgccactggtgatggaggtgaaaccatccagatcgccgacatggctgttgcgccagtaaacgtcgtcgccgttgccatagcctttgcctttggtagcgcccgcagtaacgccgaaggaggcgccgccctggccgtagctcaccgccaccccggcgttccagccgctggatttattgtcgctgcgggagtgacgctcctgctgcgcggcaacgatattgacgtcgttatccgcaaacagcgtggtgccctgtttgccgctgatgtcagagccgatgatattgatgttggattgctcgccgccggtcgccaccaccaccgcttgtttcccggcgttcactttactggcgagcgcgctggtgctggtggtgtcttcggtattggtctgcttgctctgaccgtagctcagggacacgctgacgttctgcgccactgcctgcgcgccgttatccatcacgccctgcgcggcgttcatcatggtgctcgcagcccgcgcgctgtcccaggcggcgttggcggcggccagcatattgatgcgatcgtcattactcttgccaacggtctgcgtggtgttgatgacgctttgcagcgcctgcaccaccggcacgttcaccgccagcgtaaaacctttctgctcaagggtacgtttgtactgcgaagcgtaggtgtcctgtgccgcttcgatagtgacatttttaccctgaataccgacattgccgttcggcgaggcgacgctgctgcccgtctgacggtagtcgttaccggcaatcagcacggtgtccccttgcaggctgccgaccatcgacccctgaccggccttcgcctggctcgcctgctcggtggtttccttgcgcgagccgacggtaaagccgatgccgccagagcttaacaggccggattttttctcctgcttgaggtgcgtttcgtcgttgcggccgcccatggtggtgagggtcagatcgttgcctgcgcgcagcgccacgtcgttagtgccgacgacgctgctgcctgccacggtcaggttgttgccagcagcgatgtttaccgatcccgcgctcagctcgctgccctgcacctgctgtttatcaacggtgtcgcgggtagtggtggtggttttcgacaaccaaccgttgccgcccaccactttgtgccgctcgtccagcgtgctgtcgttcagtacgccttcgatatttacgtcgtgaccagcacgcatggccagcgcgccgtcagatttcaccgccgcgccgcgggcattaatgtcattgcctgcgcccatcaccacgccgccggtggcgctcaccaggctgccggtgtgatcgcggctgctctgcgtcagggtgttgtccgcatcccacaccagcttatcgccgcgcgcggtggtgacggtatccaggttcagatcgcgtccggccaccagctgcgccttgccgttttcaccgctggcgatcacctgcgcgccggtcagggtgatgtcacgcccggactgcaacgccagtttgccgtcatctccctgcacgtaaatgccggagacgctgttgatggtggtgcgggtgaagctgttctcaccgctggcactctcagcgcttctcaccgtgctggtgacgttaatatcgcgacctgcattcgccagcagggtgtcgttgccgatgatggccccgtcgatactgttgatatcgcggcgggcattaaggcgcacatctgcgccctggatcaggcccgcctggttggtgatgttatcggcgtccagttgcagcacgcggcgtccggcgatggtgccggagttaaacagatcgccgttgagcttcatcgagacgttattaccggcgatcaacgcgccggagccgtcgatgtcccctggtttcactttcgcgtacacctgcgggatcagcacgttctgcatggagccgtccggcatctgcacgcgggtattcaccagccagacaatatcgccggtcagcagcgccatctgctccggcgtcagcgccacgcccagtttcagcgagtattgtttgccgaaggtgatgcccttatccatcagcgctttgaactgctcttcgtcgttgttgtagccgtcgaggtagcgctgaccggtgatacccaccacctgctcgcgtaccagccgctgctcgtagtagccgtcgcccagacgtttgatggtgttatcgccgtcgttggtgaaggcgttttgcatatagtcgctgccgagccactggcgctcgttggtaaagcgcggatcggtttccaccagatagggcacgtccgccgacgggttcactttaaacaggctgttgtccggcaacgtggtattggcgccgataatgcggatcgccccctgcgccgggttcacttcaaactgttgaccggctggcggcgtgacgggttcgcccggtgaaaccgtctgctgccatggcgcatgaccggcatctttgacgcccgcgttcaccagattcgcccgttcaatagtgacgtcagtccccggcgttttcagcggattgagggagagattgctgccctgtacgctgccgttgctgaccagctggcccggtttcagggtaatggtctggatcgccgtcggcggcacataggcagttctgtcgtcaccctgttcatcgctgcctttatgacggatgcggtaatagtgggtgacggtaccgacgtcggtggtgtggcgctcgccgtttaccgcatcgtttttcacctgggtcacgccgtcgatatcaagcgtccccccggcgatcacctggctgttgtcgttaaacagccgatcgccggtgatgctcatatcgccgcccgcgaggatcttcgccggatcgctctcctgaatgcgcgtctcttccaccgtgcgggtgtaatcatactggttgaaattatcgttaccgtgtccgctgcgctccggcgtattgaggttgcgcaggccatcggaggagttgccgtcaacgtaaacgccttcatcgcccgccttccagcggttggtcgagccggagtgctgatactcggtgagatcttcctgcgagacggtcaccagcgcggtggagaaatgatcgttgatgttgttgatctgtccggcgttgatacgcatgttgcccgcagattcaatggtggagctgtggttattgatcgtacccgcacgtcccgtcgccacacctttatcatccagcgtgccgccgatcgccatgtcgcctgcgctgtaaatcagcgcgtgatcgcggttattcagtgttccgacgcccagatccacccgctcacgcccggccagcgttgctgccgtgccgttttccgtgaggttattaaaggttccggcattgacgcccaccacatcgccgtaaatacgaccgctgccgatattgttcagggttccggcattgatgcgcgtaaggctgccgtcgatcagaccacggttatccagcgtcccctgtgcattcagggtgttacgcccggcggtgatctcgccgctggcggtattggtaatattcttgctctgcacgtccagcgcgccgcccgccagcagtttgccgctgttggtcagatcgcctgcggtggtcacagcggcgttgccgttggcggcgatggtgccgctgttatccagcgactgcccgctgttgagcgtcatatcgcccagcgacagcagctgtccgctgccgtcgatataatctgcgtctaccgtcagctgtttaccggcttttgcggtgccgccctggttacgtagttgcagcccgtcgccgcccagatccagcaggccggaggaggccagcgcccccgcgttgttattcagctcgccgttgttacgcacggtgagggcgtcgtccgccagaatgctgccgctctggttattcaggctgtcggtgttgagcgccacgcgctggccttccagcccctgattgtcccccagcgtgttctggttaataaaattaacggcgttgaccgtcaccgcctggccgccgcggatcagccccgagaggttatccaccacgccgcccgcgctgtcgagcagcagatcgcctactgactggatctgcccaccgctgttttgcaactgattgctgtgcagacgggtggcggactcgccgatcacccggccgccgttctggttattgagcgtgccggcatcaatatcagccgcgccttttgccgccagcgtgccgcccgcattgttcagctcgtcgccggaaatattcagcgccccgaggctgttcagcgtgccgcccgcgttgttcagatcgcgggtggtgacgttgacgccgttgccctgcatcaggccggaagcgttattcagcgaggcagcaggggagagggcgaggccgtcagtggcaaccagctgtccgtcgcggttatccagcgtctggccgtcaaaggcgatatttttacccgccagcgccacgccgccgacattatcaaacgcgcctgccgccagcgtcatatcgccaaggctggtgatgccgcctttatctccgctgttacggttgctcagggtgtcggcgctgatacgcagcgcatcgccgctctggatcagcccgccgtcatcattggtcagggtggtgccgtcgagggtcagcgcctgctgcgccgccagttgcccgccctgattgctcagggtggtagcgttgatagccgccgcgtcgccgctgaccagcgtccctttctggttcaggacctgatccgcattgagcgtcagcgccttgcccgcacccgtgaccccgtcgcggttatccagcgtgccgccgttgaggttcatgaggtcgccggatttcagcgagccgttctggtttttgagggtggcgaaacgcgcgtccagcgcctgttcagaaccgagctggccgccggtgttgtcaatatcgccgccggtaagggtaaagttgccgccgctggcgaggaagccgtcctggttattgatcgcgccgctgctgagatccagcgcgccgtgggagagcagcgatccggcctggttgttaagcgtgccgttgttgagcgcaagggtcgcgccatccgcaacaatcaccccctgctggttatccagcccggcggcattaatacgctgagttttcgccgcttcgatacgcccacgggtgttgttcagggtttgtgcgctgcgaatatcgccatcgcccgccgaagcggagatcaggccgtcctgattagtgatcgtcccggcatcaaggctggcgttacccgccaccgccagcagctggccgccggtgttatcaatggactgcgcgcccagctgtacgttgccgttggcggcgatctgcccctgctggttatcaatgctgcccggcaggttaacggcaagggtgccgctgcccgcctgaataattttacccttctggttcgacaggctgcccgcgctcaccgtgagcgtatcggcgctcagactgccgccgttattgttgagcagtttaccggtgcgggcggtgacctcgctggcgttaacctgggcattttgcgtgttcagatcccccgcgccgccatccagcaccacgcgttttgcctgagtctggctgccgctgacgtccacaccccggccgcgcgcgctgaggttgccgcctgccagcgtctgcccgctggcggtcagttgtccgctggtatccagctgtaaatcaccggcatccgccagtttgccgtcgttattcaccccggccgccagcacgctgtttttactgctggtgagggaggcggcgcgaacctggacattattgccggcggtcagcacgccgctgttgctgaattcgcctgccgtctgcacggcgacattttcgctgccgcgggtgatgccgctgttttcgatgcgtccgtcagcggtcagggtaacggtaccggcctgcgcgccaatggacccggcgttacgcacgccgacgccctgttcggtgccgaccatgcggatcttaccggcgtacatgccgccgaggctggagacatccaccgccagttgcggacgggtggcggcatcgtcgctgcctttgctgatctgttcgtgtgcggcatccacctggttgcgcccggtggtgactttcagatccttagcccacagcccggcgttcactttcaccgaacgggcgatgatgtcggtgtaatccgcgcctgaggtgtccatgcctgcgccatccaccaccacttcaccgcgttcaacgttatagccggtcaggttgccgttgttcatctgcgcctgaccggtggtcagggtggcgcggttggtgttgataaagccgcagccgctacaggtgatgcctgccgggttggcgatcaccacctgggccttttgcccggcgacttcgatcatgccgttgagcttgctcggatcccgggaattgacctcgttaaggatgatcttcgcttcgcctctcgccagccacgggttggcagacaccatgccgcccagctgcgtctgcacatttttatgggagttgttaaggatcgccccctgctggttaacgtcaaacttgctgtaattgttgcgcgacacgcccgccgccgacggcgtctggatattgacctgcgtggtgccgttggcgctgttgagcaccgtcggctgctggtttttcggcgcgccggcgtcggcgataatatccgcctgcgccgtgtgcaccacgcccatcgccagccacaggctgaagctcagcgcgctgactttgccgacgaggcggctgtgcgtatgaccgatgccggaagaacgggaagaacccgcgcggcctgagcgggcgatgtcggccaccaccatcagcatgccgcgtgctttgttgaaaacgatgcggtacaggttcttattcatggtgcattcctttaaaaacttccggcagattgacgcttaacggatgggcgtgctgccaggcttgtgcttgttcgcggctgacgtggttgccgtgcagcatcaccacgcgtttgccgagttgctgcccgcgatggtgcagggcgcgcagacagtgatcgggaaagagatcgcggcgcatcaggctgcccatcgccgcggtatggccaaagggggcgatccagtcgatacaccacatgcggtcgccggaggcccagtcttcatcgcgcatttcaatggccgggcgcgtgaggtagcgggcttccgactccggatcgagccaggcccagctgaaaaagaaaatcggctgttcgtctttcgccaccagtacgtactggcggcgtttaatgatcggcagcagcagcgtcggcagcgcgtgcagaggcgcatcccggtgcagaggggagtgcatccacagccagacgctggcgcccaggacttcggcttcgttctcatcgccgccgaggatcagcggcgctttgatgtcatactcgccaacgcgcattaccagctccagttcaggttaaacccgagggtggtggaactggtgcggaatccgtccggcttcgagaacggacgtccggcgaacaggtcataaccggtgttaaacgcgctaccgcgcagaccgaccacgccgcccgccagatgcttgccgatgagatattccgaactgtagccgcccacttcgccgtaatctgcgccaagatagagttcctgattgggaacgggcgtgcgccaggcgacgtcgttacgcacataccagccgtggctggcgctcagtgtacgttcgccgtcaaagccgcgcaccgtccagcggttgccgatggcgaactgctcctgcggcgtcagcggggtgttgctcacctgacgctggtactggacgttatagcggaactgctgcgagccaagctcaaacggcagatccagcccggcgctaagctgaataattttgctcagggcggttgcgtcaccaaaatactcttccggcgcaggctgcgcgccaaaccagcgggtgccgcgctgatagctgatcccggcatccagcgtcgcctgaccgatatagtggcggtgctgcaagccggcgcgccaggcggcggtctggcgatgctgtacaccgacttccgtatcatcgatatagttgcgggtttcgcgggtcaggatctcatagctaaatgaggttttctgcgagccgctgcggtgcagcacacggcttaactgcacgttaaggtttttgcttttgccgctgtagcggtaatcggcgttctcaccggcaacggtctgatggtaatcaaaatcgctgccggtgacccccagcatccagtaaccgaagggcacggaatagtgcgcggtatagttcttgctgcctttaccgcccttgttatccagatcgtgactggcggagaagtataaaagatcgctcagcgagaaggggttatccagcgacagggtcgcgccgccctgatagcgtccggtggtttcggtgccggagtcatccagcgacaggcccagacgccacattttcgattgcttacgggtgatgaccacatcgctctcgccgggtttctcgccggggacaatctccatgctcgcctcgaccgtaggcagacgctgtaagttttccagcccctgttcaatgtctcgcagatccagcagcttgccctcgtgcgccgggaaggcgctgtaaagctggatatagtcatcgctgtcatcagtcagtgctacgtgacgaatattgcccggcacgatagccagcttcagggttccgcttttcagatcctgcgatggggcaagaacgcgggtggtgatccagccgtgatcgacgatgcggttttgcagggtgctcatcagcaggttaatgcctttcccgcccagacagcgaccctccgcctggctggcgatatgctgtaacggcaaccagcgcggcagggcatctttgccgctgatttcaacgcggttaatggcaaagcagggcgtttcggtcgggaaattaatgcgcccataaccggtagagggttcggataaacgaacgtccggggtctgtggcgttagctgctgctcaatcgctctttgacgctgctgctgaataataaattgattatcaggttctgcggcaaagacggaaaacggaaatggcaggctgctaacagccgatattattatcgctattttatgtgacgaattcatcggacgttccgcgctgtgtaataaaaaaggaagcaatgtgaagatatgtaaaattgtttaaaaatcgacgactcaagaaaagggggattaatcctaaagaccgcagattgcgcctcaggactatccccaaatctggtaggaggaggtaaaaccagcctgcacaggtgaaataagaagcggcttaagcaagttttggcagcaggttcagggtattgccgaaccagcaaaggatcaccaccaggccaaataaaatcaccagcccaggaatgattttaccgccccacaccgtgaattgttgttgcgggaatttttgccgtgatttcagcgccagacaggccgggactattaccgcccagatggtggcgcacaggccagcgccgccgatgccataaataaagccgttcgggaagatcagatagagcgcgcagggcggcagaaaagttaacagcagggttttaaagcgtccgccgggggaattatccattttgaagagatcggccaggtaatcaaacagccccagcgtcacgccaaaaaatgaactggcgacggcgaggttggaaaacaccagcaaacaaaactcaatggtgccgttctgcttcgtacctaaaaaggatttcaccagcgaatcgacgttgccgccggaggcgataatgcctttaaaatctgcgcgcgggatgttgcccatggtgcagtacagccagaataaatagatgaacagcgccaaaagcgaaccaaagaccagacttttaaccagcttatctttgcgtttgccatagcaaattatcaggctgggaatattgccgtgaaagccaaaagaggcgaggcaaaccggtatcgccataaaaatataggggaagtaaccggctgaatggtcggcaacgttactgacatcgcgcagaatggaataatccacctgaaagaaaaaggagccaaacaccaccacgaaggcgataatttttatgccgagaaacagtgaggtgatgcggctggccgccagcgagctgaaccataatacgcaggcgacaaacagcgcagtaccgatgccgatggcgcgggcgtccacctcatgtccggattgcatggccagggtttcactgatgatggcaccgttggcggagatatatgcataggtcaggatataaagcacaaaggccacggtgatcccgctgaacagattccagcgattgcccagcagatctttggtaatggtattaaaactcgcgccgacgggataattgagattcgcttccaataacagcagccctgaatgcaacatggaaaaccaggcgatgatcagaatgaacgtcccccagaaaaaccacgcgccggcgagatcaacaggtaacgcaaacatccccccgccaatgacggttccccctatcaccatgatcccccagaaggaggagtgttttgcctcatatttatcgtccatgatgaccacttgcccggatgtattcatattatgatcgcccataatttattatgaaaacgctgtgcacagtcagcagcgggctacagggatgctgtagcccggcgcgttgcggaagggaatatcagacttcttttaatttcgcggtaaagtgacgtaatactttgggttcatacgtgaaggttaaaccttttatattgggcgcgttttcttttacatgctggaaggcttcgataataaagtccatatgcgattgcgtataggtggcgcgcgggatggtcagacgcagtagttcagccgggcagggcaattgtttgccggtttttggatcgcggcctaataagaaggagccaatttccactgcgcggatccctgccactttatataattcacaggccagcgcctgggccgggaactgttctgccggaatatgcggtaataatttacccgcatccacaaaggcggcgtgtcccccggcctgctgacaggtaacgccgatggcttccaggccgtccaccagatactgcacctgcttgatacgataggccagccagtcctgattcatgccgtcagtcaggccaaccgccaggcgttccattgcgccgccttctaacccgccgtatgtgggaaaaccttcctgcaccacgcagatcgtccggcattcggtatagacatcaaggaagctgtcgtccttaatgcataacagcccgcccatcggcaccatggcatctttttttgccgacatggcgagcatatccgcatatttataggtttcgcgggtaatttcctccaccgaccagtcgcggtattctgcttcacgttgctgaataaaccaggcgttttccgcaaagcgcgccgagtccatcactaccggaatatcgtatttacgggcaatggcatacatggcttttaagttggcgatggacaccggctggccgccagcggagttacaggtaatggtggcgacaatatagggcacgttagcgggtcccacttcctgaatgcctttctccagcccgtccaggtcaaaatcgcctttaaaatcgcagcgggcggaggtatcaaacgcctctttgatataaacattgcgcacggtacaaccattaatttggctgtggccctgagtggtatcaaagaaatagttagagaaggccaccattttgctgcggtcgagccctttttcctgctcacgttttttgatcaataccggaatataaatctgctcagcgccgcgcccctgatgggtgggaatggtgtgctgatagccaaaaatattttttaccgcctccgccagcgcataataacttctgctgccgctgtaggcttcatcgccccgcagcatggcggcctgcatattctgcgtgaccgcgccggtgccgctgtcggtcagcagatcgataaacacatcttcgctgtccagcagaaagggattcatgcccgatttaagaatggcctgttcccgatgttcgcgggtggtgcgttttaccggttcaataacgcggatgcggaaaggttcaggtaagtgttgaaaattgttcattgttcaatcctgtatttatggcgatgctaatgcctgcgctttaattatgcgcagacatgacggagcgctgccggataaagggcgcggcctcggataagatttattcagaatatgccgggcacacacgcagcagacggatctatcctgcgcggtaagtcatggcaaaaaaggagggattaagggcggtgattgacaataacggtatcgaggttaaaccactttgcggtcatatatgtgaaatttaagataatcatagtttatcaactcacattaaacatgatactacagtattacatccgcatcctttgtccacggcgggatttattaattgtgagttgtctcacgattgctttttgcggcgtttgcggggaggcagccgtagtttcctgatcatgaatatccttaacagcatgggataaaagaacatttaagccttacgacttaatgctaatgttccggcatagcaccataggggcagtgtttaaaacgacagtcgggtttttttgtgcagccatgaataaacggctcggtatttcctgggcactggatattattgctgaaggacgcccacagcgagggtgagaagggaaaagcatgaatgacgttgatatcgcgcttacggtcgttagcaacgatgccgaaagcggtagtggataaggtgttgcctttgtgcaaaaaataatctccgcgataccataagatgagatttaaattccgcacgccagatacaactgcgaatgccgttcccgttttgggacacgcgagagcctgtttaacaaaccattccatattaagtaaattctccataacttatttcgagccagttaggtaagctcttaggattattcttttatcccacgcgccaaggataacgactgagcgttcagtgtcgagggtgctttaataaacattcctaagctgacaaaataaatgtttctatatgtttccttgcaaaagatagtttaataatcagtcggaaagttgaaagcagggcataattggcggtttacactaaacttttatccacttaagcagataaaaggagcgcttatgaagttatggcctgtagtgactggtgtggcgattgcgttgacgctggtcgcctgtaaatctcccacgccgccaaaaggcgtacagcccattagcggttttgacgccagccgctatcttggcaaatggtatgaagtcgcccgtctggaaaaccgcttcgaacgcggcctggagcaggtcaccgcgaactacagcaagcgcagcgacggcgggatccgcgtgctcaaccggggatacgatccggtgaagaaagagtggaatgagagcgaagggaaagcttatttcaccggtgcgccggataccgccgcgctgaaagtgtcgttcttcggccccttctatggcggctataacgtgatcaagctggatgataagtatcagtatgcgctggtcagcggcccgaaccgcgactacctgtggatcctctcgcgcacgccaaccctgccggaagcagtgaagcaggattatctgaacaccgcccgcgagctgggattcagggtggatcagctggtgtgggtgaagcagtagccttctgttctgaagcagaccctgcgcaacggtttaagtaagatctgccatcaccttgcgcaggacatccttcaaccagatcagcgccatatccttatcgcaccgcttatgccacaacagcgaaagggcaatctccggtgtttccaccggaacgggactgcgccgtaaaccgtaatgcgccacccagtcgtccgcaagcccggacggaactgtggctaacgctggtatgcgcgccatcaaaggcggcagagaggaaaagtgtggtgtcacatagcgaaccgaacgcgctttacccagtgctgccagctggtcatccaccgcgcttgaggtcgccccgcgataggaaaccagcacatggtcatgtgccacgtagttttccagcgtcagcggcgcctgcagggaaagctgttcaggatgccagagcgtacagaaatgatgtgacacaatcttttcacggcgcagcgtagcgggcgtgctctcgccaaccgaaatggcaagatcgacttctccgcgcgcgacgagttcagcatcccggaagggatcgctggccctgacctgaagagtaacgcctggcgcatcgcgggtgatacgcgcctgcaattccggcatcaaccagcgctcaacccagtcgctcatcccaagacgaaaaacatgcgttgccccggctggcgtaaatgacgctggctgaaaaagcacgttctgcatctgttccattaaaggacccagctcagcgatcagcgcttcggcacgcggcgttggctccatgccacgtgccgtgcgtacaaacagtggatcgtcgaacatgccacgtaagcgcaccagcgcattactgaccgcaggctgaccaagatgcagcttctctgccgcgcgggacacgctgccctctcgcttcagcaccagcagtactgttaacaaattcagatcgatacgatgaaaatcattttcattaatagtgaacattactttaatcaatttgaatgatgtttattgcctgagcatactgtgaaccacgttctggtgatacttcttaggaaggtttttgatgaaaattttactgacgctggtcgcttcacttcttttttccggtccgctagtggccgctgaacaaaccaccgccctggatcaacaggcgccgggctattaccggatgctgctgggaaaagtgcgcataaccgccgtatctgacggcacggtggacgttcccctcaatacactgttaacccatatctctccggaaaaactgcgtaaggccatggataaagatgcaatgacgccgcaggccgagacatcaattaatgcctacgtcatcgatgatggtaaaacacgtgttctggtggataccggtgccggggagcttttcggacacaacggcggacatctgctgaccaatctggccgcggcgggttatccggcggagacgattgataccgtactgctgacccacattcatgcggatcactcgggcggcgtctcccgggcgggcaaacctgcttttccaaatgcggaagtgtacgtggataaaagagacgtcgatttctggcttgatccggctaacgaaaacaaggttgaggccagtcaggcgcatacttttgctgaatccgagcgcaccctgggcccggtcatcaaagcggggcggttgaagaccttcctggcaccggccatattaccgggcggaatacgggcggagtctactgcaggtcatacgccggggagcgtgctttatcgcgtggaaagtgaaggccagacgttggtgctgtggggcgacattattcacgcgaaagcggtgcagatgcccgatccgcacgtggcaattcattttgacgtcaaccaacagcaggctatcgccacacgtgaaaaaatactcaagcaggctgcggatcagggttactgggtggccgccgcgcatatctcttttccggggttaggacatgtacagcatgacggtagcggctatcgctgggtgccggggaattacacgactcagctcgggcagtaggagcgcttgaggaaatgggtagggatacaacctgggtgggcttaaaatctattcgtttaaattgattattttccgcagaataatattaaaaggataatgactattcgatatttatctaattttttatacggatcagaaagtctgaaaagccatgtgcttaagcaaagttaaaactgtgcttagaatgatacccgtgataatttttaatagaaaaagcatgtgatatgactttcttatgctctacagaaaatagagcttgctttttattgcgtttttcggagccatgagggagggaacccaaaatgcccggtaaaggcgcgtgtaaaagactgcaatgactcaaatccatacttgatcgatatagtagtaattgtatctttttgcattattatgtcgcgataagcgtactcaagcttttttgctttgatgaagaagcctggcgctattcctgtatggctcttgaatattctctggagatgccattttgaataacctgatttcacagcaagatcatccagtcgtatattttctgtgatatttttttcaatccatgttattaaatccgtacaaaagtttgacttattcataatacgacttgctttgaattttaaggattaaagaaaatatgctattttaaaataatttctgttgccgggcttacagcccggcattatttttaaaaagtatatgaaaaaccagcccagaaggacagaagagaatctttttctaccatcggactattttttacagcgtccggaagtatggtgtaacgtgagccaccatatatgttccagctatctgtcagcatatagttcatgttgagttcgacataaggtgttatactctcaccgggcgtgtattttttaaagccacttcttcccgattccttgttatttatgccgtaataatatttgttaaatttacggtcattccagttaaagcctagtgaaggctcaatgcttaacaaaccaatctgtaccggataactccatgcgttattccagtataaaccattacttgtatctaaagagtcagttgtaagcgtagtttcaaatttccccatttcaggcgactcatgtgaataacttatccctgtcattagcgtgctgtgacgattatttagctggcgcatcgcccttgagtggctatcggttgctttaaaagaaagaggtagataatatccaagtatcgcaatgcgatcggatggcgtatgaagaaaatcatacccagcactcagaccatgaaaccagaacggccctgcttcgtaatcaacgttaggaaaaacaaggttgtttttattctcatcaacctgcttgtataattttgaagaccatccagtggtcaggcctaatgaaaaatcatctgcctgagcggcctgcaggaaagctcccgttagtatcgccaccgaaaccactgactttattaaattcgtcatactgtaccttgccaaaaaattccagcttatatttattttgttaaaaaacttagtcgatcgatacctaattatttatctatatcaatctgacttctgataaatttttctgtattttcaatatactcctggtacccaaaaccttcgattcccagactgagtatcccatccaggccatgagaataagcgataaaatcccacgctattaattctttaggcctggtatatttgaactctccgtttgaggctcctttttcaagaagattcataatggcttcatgccattgtctgaccaccataccaaatgctttacgcatcgtttcatcatgaaaagaataaacttcggcttctttccataatttactgtagtgatgcgcatcctcatgattctcgacgaaaaggcaccagtgaagcatatccaggcagctggcgttttcctttatacccgcttcatacatatgtttcagagcctgatctaccgagagtttaaaagcttcggccttcagatcggaggctgatgaaaaatggtgatgaatttgccctatagctatctcagcctcctgagcaactcttcttaccgtcatagctgataacccttcctcatacgcaacttttactgcagtttccaggatcatctgacgtctcacatcacgactgagataagacatggtagttttgactcctttttgcactcaatctggacattcgttcaagttcactataaattcaacttgaacacatgtccatatcttaattttttataaggtagtaacagcatgaaaagcaaatggtacgtacttttagtagtgattatcatgtacttacctgtttcgatcgatgccactattctttacgttgttgctcccgttctcagcacgcaactccaggcctcgcataatcagttgctgtggattatggatatttatcccctcgtaatggctgctcttttgttacctatgggggcgtttggagatcgtatcggctacaggaaaatggcgatttacggaagcctggtttttggtattgcctcgactgttgctgcctgtgcgaatacgccagaaatacttatagctacccgcgcacttcttgcggttggtgctgcgatgattgtgcctgcgacgctcgctgcagtgcgcagaaattatgtggatgagaaagatcgcaatatggcactgggtatctggacaacagtcggtaccggcggtgctttagccgggccattggtggggggagtgctgcttagtcatttttactggggtgcagtatttctgatcaatattccagtagtaatgatagtaatttttttaatttccaaaactttaccagacgaaaaaggcgacattcgccagcctgtcaatctttttcaggggctcctgttaatgagtgcgttgctgatattaatttatgccacgaaaagtctggttaaccatggcaacccgattcttttatctgtctatctgtttttggtcggactggttttgttcggctgtttcattactatccagatggtttctcgttccccactgctcgacacggggcttttgacaaagcggaatatcattgctggcgtgattctggctctggtttcaatgattacgctggttggttttgagcttgtaatttctcaggagttacagttcgttcaccgtttcactccggtgcaagccgggctatatatgatgccgctaatgctggcaagttgtcttgctggaccggtcgctggttatctgattaaccattttggggttaaaagtgtcgctatggtcggacttgctgcctctgctatcagtctttatgtattgtcagatgttaatttcgttagccagactgcaaaagcctggacatggatggtggttcttggggcaggcgatactgtcgctttaatggcctcttcctcagcgattatgacggctgcaccagcagacaaagccagctctgcaggttcacttgaaggcatgtcctacgaactggggacggggctgggaattactgttttcggatccgtactggctggcgtctattccgcgactgttcgccttccggaaaacttgccgcgggatatttatgcctcagccagtaaatcgtttagcgaagctttagcgatctcgcgccacctcgatgaagcctccagggaagatcttcttaaagctgcttcttcagctttcatgcattcccatactgtcatgcttgagtcggcatcgttgattctgacgatgttgatgatcctgactttctttattttcaaacctggtaatgccttcagaagttgatgatggctgcatcgcacttatttcattgattaaatcggaaattcattatgaatatcaggaaactggccatttacacgacgttttgcctgggatttatcaccggttgtgattcgtcagagtcgaacgaaacggatccagtaccagttaaaaccaaagtagtgacaaaaatacttaatgctgaagatatttactccacacgtgtattccctgcccgggtttctgcggtgaaaaccgcacaaattcgcccgcaggtgggaggcataattcaaaagcgacttttcagacagggttcggaaatactacagggtcagccactgtttcagattgatgcagcgccgtttgaggcagatgtcgaaatggctaatgcagcagttgcaaaggcaaaggccacctatcagcagatgagtaagcgggcaagtcgattcgcacaattacaaaaaagcgcagcgattagtcaacaggatcttgaagatgcaaaagccagcagcgcgcaggcagcagcagatctcgcagaagcgacggcgtcacttaaccggaaaagactggatttgaattatgcgacggtaaaggcaccgataagcggacgtattgaccaggagttcattacggaaggggcactggtcagtcccggtgatacgcaagcaatggcggttattcagcaacttgatcgtgtttatgtagatgcccgggtaccagctcaggagcttcgtacaatttatcaggcggttgaaactgatccggctagccagtctggcgctgttgcagatgttcttgatgataaaggccagtcatatgaaaccgctgcccgactcctgttctcaggtatcagcgtcaatgacgaaaccggtgatgttgtactccgggcagaagcagagaacccgcagcggatcctgctgcctggaatgttcgttaagctaaaaatcacgcggctcatccaaaaggaagggctggttgtacctgaacaggcccttagcagggcggatgataaaactaccgtatggatagtagggcacgagaataaagccaggcgcgttgagatccagaccggagaacaaactgaaaaaggcatcactgtaacggccggcctcaaagcgggagacaaaatcgtcattgaaggtcaggacaaacttcaggatggtgccgaagtgattgcacagtctgacgttataaaaaattaacttcgtaatgacttattactacgggaaatgctgatgtctcagttctttatacgcagaccaatattcgcatgggtcattgcgctttttataattcttttgggtgtgattgcaatcccacaacttccggtcgctcagtatccatccgttgcgccacctagcctgtcaattacggtcacctatccaggcgccacccctcagaccatgaatgagtcggtgatttcattgattgaacgtgaattatctggcgttaatgatctgctttactatgaatcaaccagtgacacgtccggggtagcgacaatcaccgtcacatttaaaccagggactgatattcggctcgcacaggtagacgttcagaatcagattaaagttgtggagccacggcttccacaggctgttcgccagaacggattaagcgtggaggctgcctcctctggattcctgatgatggttggcctgaactctccgacgggtaagttcagcgaagcagacctgagtgattactttgcaagaaaaattactgacgagctacgtcgtatcgatggtgttggtaagattcaggcgtttggctcggagaaagccatgcgtatatgggtcgatccttcgaaactcatctcatataagctgtccgtcagcgatattaatacggcaattacagagcaaaatgctcaggtctcacccggtaaactgggcgactcgccttcaactgctaatcagatgacagcttatccgctggacgtcaacggtcagcttggtacgccagaggaatttcgtaaaatcgtcctcagggcgaatcctgacggctcccgcgttacgctgggggatgtggcccgggttgaacttggtttacagtcctatgcgtttgccatcagagaaaacggacatggctcaacggcggctgccattcagctctcaccaggcgcgaatgcggtacggacatctgatgcggttaaaaccagaatgcaggagctggcaaaatcattcccgtcaggaatggaatattccattccttttgatacttcacccttcgtaaaaatctcgattgagaaagttgtgcatacgtttgttgaagcgatggtgcttgttttcctggtgatgtatctctttcttcagaacgttcgctatacctttattcctgccatcgtcgcacccgtagcattgctcggcacctttaccgtaatgatgcttgcgggattttccatcaacgttctgacaatgtacggcatggttctggcgatagggatcatagtggatgacgccattgttgttgttgagaacgtcgaacgcctgatggctgaagagggattatcgcctaaggacgcgacgattaaagccatgaaggagatcaccggagcagtagtcggcatcacattagttctgacggctgtttttctgccaatgggactggcctcaggttcggtcggggtaatttatcgtcagtttacgctttcgatggcggtttctattctgttttcagcgtttctggctctcactttaacgccggcactgtgcgcgactttgctgaaacccgttacggccgactctcataaaaagaaccgttttttttcctggtttaacagaacgtttgatcgccttacgggacggtatgaaaatggcgtaacccgtgtcatacgtaaaaccgggaggatgacgcttatttatatggtcttatgtggcgttctctttttcgcttttaagtttttgccgtcttcgttcctgcctgaggaagatcagggttacttcatcacctcggtacagcttccggcggatgccacgatggagcgtactgaagccgtcgtgaagaaatatgagaagctcgttatggaacgtccgggcgttgaacgtaatgtttcaatactgggtttcagcttctccggcgcgggtacaaactctgccatggcatttacaacgctgaaagactgggatcagcgtaacggcgctacggcgcaaaacgaagtgacaaacgtacaaaatgagctgggtgatattcctgaggcaaccattaccagcctgctgccgcctgccatatctgagctaagtacgtcctcgggctttaccctccgactcgaagaccggtccggtcacgggtatgcggaactggtgaaggctcttaatatgctcctggaaaaggcgggtcagagcaaagctttatatggagtttatatggacggtctgccagatggtatggggatcagccttaaaatagacagacctaaagctgaagcaatgggcatatcatttaatgaaataaatcagacgctgtccggcgccctcggctcaagttacgtaaatgacttccctaacgaggggcgcattcagcaggtgattgtgcaggctgaagcatcagctcgtatgcagctatctgaaatattagcgctgaatgtccgtaataaaaatggtggaatggtgcccctgtctgagtttgttcgcccagtgtggcaaagttcacctgtgcaactggttcgttatcagggatatccggcattccgcgtcacaggatggcctaactggggttattcaagtggcgatgcgatggcggaaatagaaaaaatcgctgccgatttaccaccaggttttgccatcgaatggaccggacaatctcttcaggagcagcagtcagcttcagaagcgccgatgctgatgattctgtcaatgctggtcattttccttgtgctggcggctctgtatgaaagctggtcgataccggtttcagttatgcttgtcgttccgttgggtctgattggggcgataattgccgtctatcttagagggatgcccaacgacgccttctttaaggtaggcatgattactatcatcggtctgtcagcgaaaaacgctattttgatcgtggaatttgcgcggcagctccagcaagagggggagaaccttcttaatgccaccgtgaaagccgcgcgaatgcgtttaaggcccatcatgatgacatcgctggcatttaccctgggggttgttccgctcatgctggcttcgggtgccagtgccacaacccaacaggcaataggcacaggggtattcggtggcatggtgaccgggacgttattagccatattttttgttcctgtcttttttgtcacggtattgtcgctcgttgataaaatcaggaaaaaaacaagattttgacaggcaacatgaaggagagggtaacacctctcctcttatgcacatcatctcagcgtagaacggtacggtaacgattttcaaagacaagtttagaaaatctgtggtgctggtgaggaaagcttaacatcgataaagatacggagaaagtgacctacccttcaggtgtgagagcgataaatcttatacgtgttggatgaggctatcgcaaattagaaatgttcataacagcgcgaaaaggcttaatctgctataaaaaaagcccgcatcagcgggcttttttgtcacttgggagccgtggctcctttgcgtatccttttaggtcacgttactgtctggtcagagtcctaccgtgacacctaacttcctgtttttcaaggtgctgtccttgcactgtccaatcatgattggtggagctggcgggagttgaacccgtgtccgtttttctttaagcggctgaaatataatatcttatacaacgcatatttttctgcggctccttcacggctccttttacgtcccgccactgaccagctttggtcttttctcggtgttgccgtcgtactccttcagataggatccgtaatgcctgaaaagcatctcgggtcctttatgccccatctgtccagcgagccagaaaaggttagccccctggctgatgtgacgagtcgcaaaagtatgccgggtctggtacggatttcggtaccggatccctgccttacgtaaggtgggcacccatgctttttttcgtattgcatcggcgctcgcccatggcttatttgttttcggatcctcaaagatggtcgcgtctttcatgaatgtgaaggacttctgggacgcgagtaccgccatagccggatcgttgagctcgactttacgggttccagcttttgtcttggttcccttaataacgccgacaacgctcgcgctctgcacgtgcgccgttttgccgataaagtcgatatcgcgccagcgcagcgagcagagttctgagctgcgtaacccagtctgaatggcgaacataaacagattttcccattgcttgttgccagcggcagacaaaagagcatccacctctgcgggggaaagcggatcgacaatgtaatcgctgtcagcacttgttttatcactttggtatcgcgatgccgttaccagagatactgggttaatttgcagtacgccatcggtaacggcttcatcaagcgcagaacgcagaaacgacagctgattgcgtatggttttcagcgttgtagtcctgctttgtatccaggctttcattgcagctggagtcaactcactggccgggaatgaatgtaaggctgccagtgcactccggcattttttataaccaccgatcgttgaaggtgataattttcgcgtttcacatatgccaatgtattcatcaaggtacattttgacagttttaccggcagcagcattaccgaatatttttaatcgtgctgatcgcggaaaatactcagcatatacgaaggtaccgcgctcaattttattgtggatttcgcccagtgcccgctcggcatatttgaggtttttactgttcacttccagattggaaaggggttcacgacacttaacccctttatatgtgaaagttatatttatcgtttctccctggctgtgtttccttacggtcacgccgcgcggaagttgtggcgattctgtcttgcccatttagcgacctcactaagatctatccatctttccttaacgccttccactttcagcacctgaacgccttccagccaaacgccacgctgtatacgcttgtttatggcctcaggcgactcgccagtttctttgcaataagtcgagattggtacacaatcgaggttcagcatagtttctccactccggctgcaaccggcttattcatgttaggaattattcaattgattcttatcagtaacggtatctttaatgctatcgacttggcttttattaaacaccatgtcagaatttaagttttcgttgattttaaagcacatataattttcaaagcgctcgtgatagccgtaacgtaatattgcatcaatgaggatgtcttcattgatatctctcaggaaattaaagtggaatggattttcttcattaaagaaatgccctgtatctataatgcaatgtttttcttgagcgcctatcttatagaaaaatatatacatcatcctgcttgttagtgttatttcattaagtttatagactccttttgttatcatgttttgtacgggttcagttatatggctctcaatgtcacaatttattttacacccccctgttgttattatggtgaatgaaattgtctcgagcagttctatattgactaactcaccatgtaaacgtaagttgctgtattttgggatgtctattttctgagtttcatacccttttaaaagaataggtgtttcaaaatcaaccaaggtcaactttcctttattattgatgtccatttcaactctagatattgatattgaattatctcttttattagatattattattgctggtatatgtgaatcataaattctactgctgcttatagaatatgatatgcaaactttttttgatgttttttgatatccaaaataaatggtgaatccggcagcgaagaaagttaaaagttttatgtcaaataatgaccataaccattcgaaaaatgaccacaaaatgagcaggtgttctataacttttggattatacataaaaatcaccgatattaattatttaatcttataatcgtaaatgtattcactcgctaattcaactgcaacttagataagtcaacgagaaaaagaactgatagcttgttatacattagaaatatacatatcggtacatatcaccttctttatttccaaagaccataacgtgaagaaaactttctttatcggagctagatttttgctaaggctcacatttatggtgtagccactagcaaactgcacaatcttcagtcttttgaatggatgcagagaaccagacttgacccgcagggcttcgtgctgccaagttgagagatcatagtcatcattttctggggcgttcccttcttgtcccgatagaccacctgccttctgagatcgttagcattcatccatgcgttgagttcctcgttggagatatactcacgcctttcatagaattcgtcatataccggtttagtccagtagccatactgatcgtgctcaaccgtaagcggagtgattgctaggtgaatgggaggcttgtcggctgcgactgggaaagctgattcacagcgtagctgggcgacatattgctctaaagcgcttgtgacgttttctattacaggcgcttggtggttaatgtgtatacgacgcaaattaactgctaaacccgccgtttctgcgcaccaagagccaaggactgcatcgctggttggcgttttttcgagcgcgtagcaaacatcgtaagtgctgcatggttcatctttgccacaacccatgcagaagtggagtgagtcgctatgaatcttaatttcggactttttcacagcattctctccagtcagttgcttcgcctcgttccgtgattcgcacagcgccgcgaactgaacatcaaggcggtctgctactgcggtcattgactttgctgctgctggtggcgtaacaagggctgttactctggagtcggcgatcaactctttggcattcattcgcatgtaggtatctcctgtgcgcgctgcaacgcgtgattttggttgcccgaatccctcgccagctggcgataattacaagggcctcgcttctttaagcaccgcggcagggcacttactaaagcgggaggttgcaaccgcctggttagttctccacacaactggaagcgcgctccgcggagtttgcattaacgaccagacactaagaggagtgaatggagcgcgctttcagttgtataaaaaagtgcggcgccctcacgggaaaataagatcagacgccgccaacagactacacacgttcgttttattggaattttggttgtgacaccggggcgccacacccgcttacttcccgccgctcggttttggtattggtcaccagtacctgtgactcagccgattttcgggtctttgcgtcggccggcgctgcagctcgcttgagcacatcacaactggaagcgcactccagcacgtttatacctgtcacccataaccgataagttagggagtgcgctttcatgttgggacccggtctttttcatcgcctcgctattcaccaaaaatcaaggttggtttaatctgggattccaaaaaaagtaactgagttcgcacgaagtgatatgcaatacggcgcgaattttaaggatcccagtaatggtttcgttattaaaacaaaacggtaattcctctactggagtgcatatgcttcagcgctcaggcaagaaatttaaatttcgttgcagcatagataccctcgaacgtttcacatctgcctcagtaaaagccgagcatctaaagcagtttacggcccgtaaagatggcgtatatcactcagagctgttcgacactctggagcaaggtaaagcggagttatgcgccttcgttaaaaaggtaaccggcatcacctgcaccgcctgaagcctgttccgacagagtggttttggacttcctagatttttaaagagcgaagcgtcctatagggcgctttttattacttgcgaatcatccggtcattcatatgccaccggcggctacttcgtgggcgtcctgcctgttcgctgttcatagtattaaatgtacctttagttaccttgatggtcaagactccaatgtacttaatgttacatggaggtgcacaaaaaagccggtctaaggtaaccggctatactgtttaacgttaaatattttgggttatctggactactttgcccacgatgcggcagttgccgtcaataggtatggggggaaatgctgggttcaagggcatcaggaaggaatgagggctatcccagactaattttttaaccgttgcctccgaagaaccatctaatatggccacgacaatttttccatacaagctgtcaagttgaccatattgtggctcaacgatcactattgaaccttcgggtattgagggtaacccatgagggttcgtcatagactcgccgcgcacaattaaaccaaaaacttcttcagaaacatcagcggtggtttgtgtccatgtaatcacgtcggtcaaccttgaacttgcgaaagtttctgtccagtggcctgcctggactgcagaaataataggtacagctttgggtggttttatgaatggaataaccctagtgtcatcatctttgttatcaccctggccatataaaagccattcaggcgttgtagataatgtttttgcaagctgatgcaggttctcgccatctggcttagttgtgccattttcccatttagttactgatacgcgactaacaccaagctttttagctagtgcttcttgagttatgtccaactgtagtcgcttggatctaatccggtctttcatctctgttctcatgtaacttatgttacacatttgcatggtaacagttgtttgctattttatgtaccttttgttacctttatgacgtcaacgtataggaggattcatgcacaaaagagaggtagtggagcatttcggtggcatctcaaaaactgcaaacgctcttggtatttcacatccagcagtttgtcgctggggtgaaattatccctgaaaaacaggcattcgttattgagcgaattaccaaaggcaaacttaagtacgacagcaagctttatcaaaagcctaacgaaacggcagcttgaaagtaaccacagaaacaagaggtgaaccgtggataacaaacactggcaggtagaaaaacagcccgcatggctggtggccgccatcaaaaaaaccatatcagaactgccaggcggatacgccgaagcagctgaatggctgggtgttaccgaagatgcattgttcaaccggctgcgcgcgggtggcgatcagattttcccgatgggctgggcaatggtactgcagcaggcgagcggcaagaaattcattgctgacgctgtctctcgccagtcgaacagtgtgaatgtaccgctggtggaaattgaagacgtggacaacgccgatatcaatcagcgcctgatggaatccatcgagtggatcggcaagcactcctcatacgttcgcaaagcgactgctgacggcatcattgaccaggccgaacgcgcacaaatcgaagagaacagttatcaggttatggcgaagtggcaggagcatttgacgctgctgtatcggattttctgcgcgccagaaaagagtgacgcccgcgagtgtgcagctccgggcgccgtggcgtttcgtaaacatgtggagaactaacgcatgaacagtttaacggctatttgccgcttaccgcaactgcggatgatcccggtgccgggacagccgctgtttcggtatgaacgcagaatatcaaaccgctgggtggcgtgtaaccacagccgcgcgcgggcaatcgtgggtgtgtattaccggagggcgaaagcgttatgcgtgaactcaaccgatggttcaaagaccaccacggcattcctgtccaggtcatcagatgggagccagaaacccggcgcgttatctatctgcgaaaaggttatgagtacggtgaatgtttcagcccgctcgaacagttccagcgaaagtttagggaaatagagggcgatcatgagcactaaattaaccggctacgtctgggacgcatgcgccgcttcaggcatgaagctctccagcgtggctatcatggcccggctggcagacttcagcaatgacgagggcatcagttggccttccatcggcaccattgcgcgtcagattggcgcgggcgaaagcaccgtgcgtaccgcgatcgcgcagctggaaaaagacaactggctttcgcgtaaacaacgccgccagggaaaccgtaacgcgtcgaacgtgtatcagctgaacgtggcaaagctccaggccgctgcattctctcacctgtcagatgctgacccttcaaattctgacgcatcaaaatctgatgcatcaaaatctgacccctcaaaatttgaggcatcaaaaaacagggctggcggcagttttgacccgtcagaatctggcggggatccgtcagtaaaatcaactacagatccacaagtaaattcaaaaccctcttgtccggttgcggggcaacccgaccgtgaagttttaatcactgatcaggccaaacaggttttaacccacctgaaccagaaaaccggatcccggtaccaggtctgcaaatcctcgctggagaacatccgcgcccggctgggtgagggctttacacgtgaagaactggttctggttgttgactacagcacggcgaagtggggcgaggacctgaaaatggcggaataccttcgtccggccacgctgtttcagccaacaaaatttccggcttatctgcaggcagctacgagctgggaaaaggccgggcgcccggttcgtgaaaacggacaatgggtcagcgccatggtcgcccgcgccagctatgacaatgttgattactcgcagattccagaggggttccggggatgacagtcacgaacgaaatgcagaataaatattgcctggcgctggccgaactgcgtagccagccagcccatgaactcaaacacgttggcgatcagtggtgcacaccagacaacatcttctggggtatcaacgccatgttcggtccgctggtgctcgatctgttttccgatggtgaaaactcaaagtgccctgatttctatactgccgaagacaatgctctggcgcaggactggtccgcccggctcgaagaactccatggcgcagcctatggcaacccgccttacagccgtgcatctcagcacgagggcgaatacatcaccgggatgcgctacatcatccagcacgccagcgcgatgcgcgataaaggcggacggtatgtatttctcattaaggcagctaccagcgaagcgtggtggccggaggatgccgatcacatatcgtttatccgcgggcgaatcggttttgatctgccgaagtggttcatcccgaaagatgaaaaacaggtaccgtcaggagctttcttcgcaggggcgatcgctgtattcgacaaaaactggcgcggcgcggcgttcagctacatcgatcttaaggatcttgaagcgcgcggtaatgcatttatcgaacagatccgccgcgaagcgctgcgcctgttaccccagatgcagcaacaaaatattccggaagttattcctggcgcaggcgatgaggctgtcgaatgcgcagaagcgctggatttggccgatgaagttgcgctgccagcaccggtaaccagttctgaagacatcctgccgctgagccaggcagatattcttgcgaagagcggtatccaggcatgggcctgtgtccgggcggtgttcggcgacaaggaagagtacaccttcaaagagtcaaaatttgctcacgtatgggcctccgacaatgtttcccagccgaccgttgtcatggtaagcgcaggtgacattgctgtggcagaagttctgatcgctgagaaaagtgtgcagctggctgtcagcgaatggctggatctgaattacccggagaatgacccggcaaaagccgatatgcaggaacggctgaatatcgcaggcatggaagcgatgaacgaatatggtatggcgatccgggaatttctggatgtcatcaaagaaatggatcccgcggcgcgctgcaacattcgcactattcgggtcacgctgaaggatttcagcagcaaagcctccctgaaggaggatgcagcgtgaaaaatctgaccgcccgccagcaggaagttttatccctgatcgtggctttccagaaagagcacggtatcccaccaacgcaaaaagaagttgccgacctgatgggggcatcgtcaccgaacgcggccactgacatgttgcgcgcactccagcgtaaaggcgcggtcaccctgatgccgggtgtaagccggggcatctcgattaacagccagagcgctaatgataaggctatatcactgctgcgctcgctggtaaacggtgaagagaatgccagagcgcgcgccgccgcgttccttgggatggaggtgtaaaagcatgatccattatcacggtggtccgattactcctgatacctgcgcaatccgggcatggaaagcacggcatgcatttatttcgttcgcgcacgcgggtcagatagccctcgccgctgaatattgccagtcttttgccctcgacaatggcgcttttaccgcgtggaaagcagcaggtcgtaacaaaatcgactggggtgattattacgagtttgtggctcggtggaaacaccatccagggtttgatttcgctgttataccggacgttatcgacggtggagaaaacgaaaatgatgccctgctggatgaatggccacatggtgatttttacggtgtgccggtctggcacatgaatgaaagcgatgagcgttttattcgactgtgcaaagccttcccgcgtgtggcgatcggcagttgcggtgaatatgacgttaagaggcctaatctggcagtagcgagaatgaaagatctgatcagacatgtaactgatgagcatggtcagccgatcgcaaaactacacggtttgcggatgctgaaccctctaattttcacaaaactgcccctttccagcgcagacagcaccaacgtcgcccgaaacattggtatcgacaaagcatggtcaggtgcctacgcaccagcatcaaaagagacgcgcgcggcgctgatggttgagcgtattgaatcgttcaacagccccggttcactcagttattgcgagcagcgggacaagttcaacatgcagttacagctggctgtgtaggagaggttatgaaattacaactgccattcccgccgagtgttaacacctactggcgcgccccgaataaggggccgctggccgggcgccatctcatcagcgccgccgggcgcaaatatcagagcgatgcatgcgcggcgatcattgagcagttgcgccgcttaccgaagccgtccgcggaagccgctgcggttgaaatcatgctgtacccgccggacgcccgccgccgggacatcgacaactacaacaaagcgctgttcgacgcgctgacgcacgctggtgtctgggaggacgacagtcaggtaaaacgtatgctggtggagtgggggccagtgataaagaagggaagggtagaaatcacgatccgcaaatttgaaaccgtggcgagtgcagtcgccgaataagtggagaagagcatgaacgagttaatcaacgtaaccagcgcgctgacgatgtccagccgtgaaattgccgatctggtcgattcacgtcacagcaatgtacgcgtcacgattgaacgtctgatggcaaaaagcgttattgaggggtatacggcaatgcagtacacccatccgcagaacggccagcagtatcagtattacgaagtgagcaagcgcgacagctacatcatcgtggcgcagctctgccctgaattcaccgccaggctggttgatcgctggcaggcgctggagcatgcacagcaaattaacgtccctcagtcgctacctgatgcgcttcggctcgccgcggatctggctgagcaaaagcacaagctgacggcagagctggccgccgcggcgccgaaggtggagtttgtagatcgctactgtactgccagcggatccatgtcgttccgtcaggtggcgaaattgctcggtgccaaagagccagagttccgcctgttcctcatcgataacaacatcatgtaccggctggcgggcgcgctgacacctcatcatcagcatatcgatctcggtcggttcgaagttaaaaccggcacttcagcaaccaccaatcacgcattcagccaagcgcgctttacggcaaaaggcatcaagtggatcggcgggctttgggcggaacatctggcgaaaggaaaagctgcatgagggcactgctcaaaccggtcgttgtccgggagctgggtgtggtgatgttccgtcccggagcagagttgctggcgcacttcagccgcgggcgcatgttgctggagaacgaaccggaacgtctggccgggttaccgtccgggcaaatcccgcccgccgcgcagccgctggcagaagattcgatgctggtacccgtgtttgaaaacgagaaggtgatcgcgcgcgccggaggcatgttaggcctggaaaactggctgatgcgcggcggtgaatgtcagtatccgcacggcacttatcacatggaaaacgtgacggcatttcatcatgcacctggcgtgatccgcgtctgctggcactgcgataacacactgcgcggccagtctaccgagcgccttgcgggcattgcccgggcgaacctggcgcagtggatcattgagttcgtgcgaatggccctgggctttgatgatacccaccagctgacgatcccggaactgtgctggtggctggtgcgtaacgacctggctgacgtcatttccgaagatctggcgcgtcatgcattgcgcctgccggtggcaaccatttcgtcggtgtatcgcgaaagcgagctggtaccggcaccggcggccaccagcagcattgaggaaaaggcgaagcaggtgctggcgttgcgcatcgatccggaatcgccggaatcctttatgcgacgccctaagcgtaagcgctgggagaacgagaaatacaccaggtgggtaaaggcgcagccttgcgcctgctgtagcagccctgctgacgatccccatcacgtcattggctacggtcagggcggcatgggaaccaaagcgcatgacctgttcgtgataccgctgtgcagagcgcatcacgacgagttgcacactgacatgaaggcgtttgagaaaaaatattgcacgcagcccgagctgctgctgaagacattagaccgcgcgctggcgatcggcgtactggcgtaatttagtggagaaaaatgatgcgtgatattcagaaggtactggaattatggggcgggtgggccgccaacgatagcgcaggcgtagattattctcccatcgctgctggctttaaggggcttttaccccaaacaggcaagtcgaggctttcatgtactgatgacgatgctttaattatagagggatgtcttacgcgcctaaaaaagaggaagccaaacgagcattcgcttttagttgcacattacctttacggcatgtccaagcgtaagattgcaaaggcactcaaaaaggatgaaaagttaattagagtcgagatacaaatggctgagggatttgttgaggggtgtttatcatttcttgaggtacagcttgatatggacattcatcttaataaataatattttttaactagtaaggcgataatttgtatcgccttactagttggtatattaagaaaatgttgtagggtaaatctttaataagttgactttgtattgcattgccagatcacttacttcttgtgcattgatagagttcatatatggattaattaaatactcatcaatgtctgaatctttgtttctcgatttattaacatctactactgacgcaacatcatccattaactccaaagcataaataaattctttaacgtttgcatcgtcttttctaacagtaaatactatcccttgtggtttaagaagttttgattttttataaaaattcttagatagactaactgaactctcagcgatatttctctttgctaaatcagatataagagactcaaggctatccagtctatgcattaaaaccttttcgatagatgggatttctgttgactcattgataagaatggaattagcaaccctatatatagggttatcactaactaattcttttgttgcctcttcaattgctaccttcaatcttggaactagctcaaaagcccctgccatgtcgttgcgataaaatattgctctttcatcggaaatgtcgaatggtagaactgtaccttcttcagcaattgttactacaggtttacgtacggcatgtctaacagctaattcatacattacgtttggatttaactcagttaaatttgtaataactaagtcatcttttagtaaatgctctatcacctgtttagtgatagaccctagggaagatatttcatgcgcaacatgcaccttataccctttttcgattaacacaggcctaataacagtatcaagaataccctgtgcttttcttcgagtttgtgaatcagaatttccaataggtgttacaacgaaacaatgcttctcagtgtccatcttctgcttagtctcatttaatcatgaagtcataaaagttgtttgctacgttacgatagattgctaaaaaaaacactaatgcggtccgcaaaaattggattagtatgttaagaatgcttacttagtcacgttacttactcagtaaaacctcgctttcacgtggctttataattgatatgtctattaaaatcataaacttatcagcataagcatgatgtgcggttcgcttctaatatcagcatgccagtaattaaggcagtagtgtcaggctcacttcggtgggccttttttatttcccctcatctgagaggatccacatcagtgacgagggtctaaatgtccgaacctgtatccgggtctgttgcagctgcgagtgcgttaactggtgccagcctttacgggatgctgaccggcactgattatggtgtcgtgtttggcgcgttcgccggtgccgttttctacgtggccaccgcagcagatctaactattattcgccgatctgcatacttcatcgtttcctattttgcaggagtatatggttcggggttagtgggctcctggctcgccagcatgaccagttacaacgacaagccgcttgatgcactgggcgcggtgctcctgtccgccgttgctatcaagacactcacgtttttcagtgagcaggatccgctgacgcttctgcagaggtggagaggaggaaccaatggtaataagtgatcctctggtgctgaccaacgtaatgacatgcaccgcgattgttctgcgcctgatgatgttccgtaagccgggcggcaaacataactggtgggcgtcttggctggcgtacctgatcatcctggcgtatgcctctgtaccgttccgcttcctgttcgatttctatttccacgcccactgggcaaccgtcactatcaacttaatcatctgcgccgccgtgttcagggcacggggtaatgtggcgcggctgttctacgttctgaggccagagtgatgcagacattaaatacgcagcgcaaagcatttctggatatgctggcctggtcagaaggcaccgacaagcctggacagcccacccgcaatcgtggttatgacgtgattgtgggtggtacgctgtttaccagctatgccgatcacccccgcaaactggttacgcttaacccgaaactaaaatccacggccgccggtcgctatcagctcctgtcccgctactgggatgtgtaccgcatacagctcggcctgaaggatttctcccctgccagccaggatgcagtggcactgcagcaaataaaagagcgtggagcactaccgctcattgataagggtgacattcggcaggccatcgaccgttgcagcaatatctgggcatctcttcccggggcgggttacggccagtttgaacataaggttgataatctgatcgccaggttcaaagctgctggtggcaaagtcagcgagccaacatcatgatcgaaaccttcacagcgctggggaaaaaactctggttacccctgctggttgccgcagtgataggtgcacaggcgttcttcgttaaccactaccgcgataacgctgttacctacaaagatcagcgtgacaaggccaccagcgcgctgaacctggcgaaagaaacgattaccgacatgcagacgcgccagcgtgaagtggccgctttggatgccaaatacacaagagaactggcaaatgctcagaaaactatcgatcagcttgagcttgatgttgctgctgggcgtaagcggctgcggctcaacgcaaaatgtcccgcgaacggagaggccagcacctccagcgtggatgatggctccggccccagacttacagactccgctgaacggaattattacacccttcggcgacgaatcgaaaccatcaccaaccagataaccggcctgcaggcgtatgtgcgtgagcaatgccttagttgacttcataaaatagttacacaaaagcatattttttgatcttacagcataaatagatttctcattctgccgatattaaaagtttgaatctggcaaagggggcattatgcgttgcgttaattgtggttcagatcgtgtcgatacaaaaaattatggtaaaaaagttggtacaggtataggaactgctgctggtgctgtgggcggatacgctggagcgacttcgggagcgtctgctggcgcagcattcggcgcggcactaggctcatttgtgcctgttgttggcaatcttgtcggtgcagctgctggtggaatcgccggtgggattcttggggctcttggaggaggtgctcttggagctaaaacgggctcattggctggagaaatggtagataaaaatctcctggataattatgtttgtttagcatgtggccattcgttttcctcctgaagctaataactgcttttcaccaacgagattataaaaatttataccgcctccgggcggtttttttattgccgttaccatggatagttccatcgtaatgactacagaaggtaaaccgtgaatatatcctataagggataaagcctagcctcgcctctgcggggttttttattatctaatggagctgaaatgaagaaatatttagttgctttgctatgtgttgtgtctgcatcctcatttgcggaaacatataaaaattaccctgagattcctgctccggctgtaggttttgccacggaggtaattagctatcaacccggtccaaatgtggccgctggacgagacgatccgaaactggttttgggtgctccggcattttatagccctggcaaggcaccattttcactgggaacaggtggaaatgtcgttcttggtttcagcccggatgctattaagaaaagtggcactccagacgcggatttttatatctatgaagtcggtcagtatgagtcttgggatgcatacctatctaacgatggtacgaactggatcaaggctacagcctctttcagtaacgtgaacccgcagccggcctcctccacttccttcactcgcgggtctgtgattggttacgacgtcgacttgatcagtggtacagccgattcttttcgttatgtgaagatcgttgatacaagtctgtctacgtatgcaggctctggtggctcggacattgacgcagtcgtagtgaccagcgctaaggccttaggtcacgatgtgctggttgataccgattctcgaaacggtaaggtttataacctttatcagaatgatgttaccggggagatcggcgttaaaattatctacaaagacagcaaagtcacatacgtgccgttctcaactgacaattcgctcaaagcgatcgcactgtcattacaaggggacttcaactgtgacgatgaaaaagacatcaacgttctcgccacgcgctcgaatgataatgtgcaggtcaacattctcaaacagcaagatggaacgtcgattaaaaccattgataacgatgtaacaaagtaagaaattacagcagtcatgcattacgttgttatgaagtaatatagcccatctagagatgggctatatattttaaaggctgatgattttttgctctgataagttaaccagtaacaattcaagaatgcttttacctttataatcattatcagcttggcaaatagattttggttcgtatacgttctgaactataaacccatcatcagtaatgtaaattttaagtacggtctgtttttcataacgactcaggtcgatataaaattcaatttcgttgcaataagatgggtttcgctcaagatcgaaaattttcaatttggtctggatgtctatggtaaaaccaaagtcggagaattctaaatatttccgccttccatcaaaattaggtgtaattagttcgtttaaataagatacggatttaatataggcagagatgtttttgaataccgattcgacagagcggtcaatgctacgaagatcactttcaatagtggctaagagatgtgaaatggtaccaatccgattcatagtcattccttgtgtttgatggttgtgagcttgatgctcagaattttatataacatttcaagtgagtattctatgcccagtgcaattcctcgagcatgtcgcaaacgtggctgccctaaaacaactactgaccgctctggctactgtgatgcgcacataaatgaaggctggcatcagcatcagcgtggattgagccgtcaccagcgtggttacggcagcaattgggaaaacatccgggagcgtattcttaagcgtgatcgtcatctgtgccagaactgtctgcgtaatggcaggccgtgtccggctacaacagttgaccacattcaatctaaggctcataggggaagcgatgaggacagcaatcttgaaagcctttgctggtcctgccacagagcaaagacggcacgcgagcgcctcaagtgagagtcaatatcattcagggggaggggggttaaaagttcaggctcctgcctgcaaaggaccgccgcctaaccttttttcacaccgccgcaggttagaaaacttttttatggggatccccaccatcgattaataggagttttcgattatgcccggaccaccgaaaaccccgacacacctggctctggtgaaggggaacccatcaaaacgagcgatcaataaaaacgagcctaagcctcctgcaggggtacccccaactccgaagcatttcgataaacagggcaagtactggtttaagcgaatggctgatgagctggacgccataggcgtgattacccagcttgacgcgcgcgcgcttgaactgctggttgaggcgtataccgaatatcggcagcactgcgaaacgctggagattgagggttacacataccggactgaaactcagactggtgatgtactgattaaagcccacccggcggcaatcatgaaatctgacgcctggaagcggatccgcgccatgctgggtgaattcggaatgacgcctgccacccgaaccaaggtaggtggaaatggcccggctgaggccgatcctctggaagaatttcttaaaaagcgcaaatgatgaatggcaacggtttcggaaggtattcagtacgccgagcgcgtgctgtctggcgagattgttgctggcgaactggtacgcctggcgtgccagcgattccttaatgacttagagcatgggcctgagcgcggcatctacttcagcgaggaacgcgcccagcacatactcgatttttataacttcgttccccatgtgaaaggggcgctggcaggcaagccaatcactctgatggcctggcatgtttttatcctcatcaatatttttggtttcgtcgttcctttaatcgatgaaatgacagggcaggcggtggttgatgaagacggtgacactgtcatggtgcgccggttccgcacggcttatgacgaggtggcgcgtaaaaacgcaaagtccacactttcgtcaggcattggattgtacatgaccggcgccgacggcgagggtggtgctgaggtttactcagccgccacgacccgtgatcaggcgcggattgtttttgatgatgccaagaacatgatcaagaaagccccccgcacgctggggcgtctttttggtcacgttaagctgaacattcatcaggagcgcacggcctcaaagtttgagcccttgtccagcgatgctaacaacctcgacggcctgaacattcattgtggcattgtcgacgagctgcatgctcaccgtacccgtgatgtatgggacgttctggagaccgccaccggcgcacgccttcagtcactgcttttcgcaataacgacggcgggaaccaataaagagggcatctgttacgagcagcgggattatgccatcaaggtgttgcgcggcgtggtggaagatgacacttactttgctctgatctataccctggacgaaggtgacgatccctttgacgaggccaactggccgaaagctaatcccggcctcggtatttgtaagcgctgggacgacatgcgccgccttgccaaaaaggcgaaagagcaggtcgcggcgaggccgaacttctttaccaaacacctgaacatctggttaacagctgagagcgcctggatggatatggaccgctgggcaaaaatgcctggtattgccccggaagctgagcgcaaggcttggccactctgggttggtgtcgacctcgccaacaaaatcgatatttgcgccgcagttaaagcctggcgcgatcccgctggtgaaactcacatgcagccgcgtttctggatcccggaaggtcgactggaaacagcgcctgcacatatcgccgagctctacaggaagtgggcagccgccgggtatcttgaactgactgacggggatgttatcgatcacgggatgattaaagccgacattgtacagtgggtgaaaggcgagaacatcaaggagattgctttcgatccctggagcgccgttcagttcagcctgtcacttgcggaggaaggtttgccgctggttgaggttgctcagacggtcaaaaacctttctgagtccatgaaatcagtgcaggcggaaatttacggcaacaagttccaccacgacgataaccctgtgatgcggtggatgatgtcgaacgtcacggttaagccggacaaaaacgacaacatcttcccgaacaaatccacacctgaaaacaaaattgacggaccggtcgcactgtttacggccaaaagccggatgctggtcaatggcggtaatgacgctcaggatctgagcggcttctttgaaaatccaatcatggtaggtttctgatgaagaaaagtaagcagccgggaaaggtgaaaagcgccttgctcaactggctgggcgtgcctatcagcctgactaccggaacgttctggcaggagtggtacggcacgagcagcagcggcaagttggttacggcagataaggcgatacggctgtcagcggtctggtcctgtgtccggctcttgagcgagtcggtttctacattacccgtcaagatctatacccggcaggctgatggctcgcgcaagctggcgcaggatcatcctgtttatcaggtgctgtgccgccgcccgaatctggaaatgacgccgtcccgatttatgttgatggtggtggccagcatctgccttcgcggcaatgcctttgtcgagaagctgtttatcggcaataagctggtgtcgctggtgccactgctgccccagaacatggtagtaaagcggctggacaccggtcgtcttgagtacacctataccgaagacggcaggaaacgcgttattccggagaagaatttgatgcacatccgggggtttggcctcgatggtgtgtgcggcatgatgccaatgatgacgggccgggacgtgatcggcgcggcgatggccgtcgaagagtcagccgccaagatcttcgaaaatggcctgcagagttctggttttctttctgctgatgctgcgcttgataaggagcaaagagagcgacttcggggatatatgcaggccttcaccggctctaaaaacgccgggaaaattatggttctagaaggcggtcttaaataccagaacgtcaccatgaacccggaagcagcgcagatgctggaatcaagatcgttcagtatcgaggaaatctgtcgttggttccgcgtgccaccgtttatggttggccacacctcgaaacagagcagctgggcgtcgagcctggaggggatgaacctgcagttcctgacccatacgctgcgcccgctgctggtgaatatcgagcaggagatctcccgctgcctgcttaacggcgaagaagacctctttgccgagttctcagtagaagggctgctgcgcgccgatagtgctggccgtgcagcgtactataccagtgcgctgcagaacggctggatgtcccgcaacgacgtgcgccgtctggagaatatgccacctatcgaaggcggcgatatttacacggtgcagctaaacctgacgccgcttgaagatttgaaacaaaacagccaggccgcgcaggcatttgcgctacggcaggttcataaccacgtattccctgatattcccttcgaacagtcaccgctaaaaaaagcggcttaggagcatccatgacaattaaaagccttccggctgcgccggaggggcgaccttttgcgcgcgaaaaacctgatctgccagctgcggcaatggagcgctggaatggtggcattcgcgccgcccgcgaaggtgacaacagcatttctatcttcgacgtgatcggcgctgattactggggcgagggcgtgaccgccagccgcattgcaggggcgcttcgttcgctcggaggcgctgacgtgacggtcaatatcaacagccctggcggcgacatgttcgaggggctggccatatacaacctgctgcgcgagtacgaaggcaaagtaaccgtgaaggtgcttggcctagctgcatctgcggcatcgattatcgcgatggctggcgacgacgtgcagattggccgcggcgcgttcctgatgatccacaactgctgggtctatgcaatgggcaaccgtcacgacctggcgcagatcgccgctgacatggagccatttgataaagcgatgagcgatatctaccaggcgcgaagcggtcttgatgccgacaccgtcgacaggatgatggacggcgaaacctatatcggcggcagtgacgcggtggcgaagggatttgctgacagtctgctctcagctgacgagatagctgacgatgacgacagcccggcggcggccctgcgcaaactcgatgcgctgctggctaaaaccgatacgccgcgttctgagcgtcgaaaacttcttaaagcactatccggaagcaagccaggcgctgctgccaaccctgacggtacgccgagcgctgccaccatcgaaaacgaaactattgaccgactggaagccgcactcagcggcctgaaagcggctgcccagtaaaacggagaaattatgtctgatgtaaatgagatcctgaagaaagttagcgccagcattgaagaggcgaccggcaaattcaatgcaaaggcagaagaggcgctaaaagaagcaaagaaaaacggccagctgtcagcggaaaccaaagacaccgtcgataaaatggcagtggaatttaatgccctgaaagaggctgaaaaaacgctgaaggcggcgctcggcgaactggagcagcaggttgctcagatgccgctggcgaatgctgcaacggtgatcgagaccgtcggccagaccgtaatcagcagcgaagcactaaaagcgttcgcggcaagcgtggaaggcggtaagcgcgtcagcgtgccggtaaatgctgcgctgatctccactgacgtggcaagcggagtggttgagccgcagcgcctgccaggcattgataccgcgccgaagcagcgactcttcatccgggatctgattgcgccgggccgcacctctgcaccggccatcttctgggtgcagcagactggcttcactaatgcggcgaaggttgtgcctgaaggtaccgccaagccgtacagcgatatccagttcgccacgcagatcactcctgtaaccaccatcgcgcacatgttcaaagcgtccaagcagatcctggatgactttgcgcaactgcagtccactatcgacgctgagatgcgttatggcctgaaatacgtcgaagagcaggaaattctcttcggtgacggtaccggcgcgcacctgaaaggcatcgtgccgcaggcttctgcatacgatgcagccttcacggttgagcagcagaacggtattgacgatctgcgtctggccatgctgcaggcgcagctggcgcgcttcccggcttccggccacgtcctgcacttcatcgactgggcgaagattgaactcaccaaagacacgctgggccgctacatcctggcgaacccggcggcactgaccggtcctaccctgtggggcctgccggttgtggccactgaggccgcagcattccagggcaagttcctgaccggtgcgtttaacgcagcggcacagctgttcgatcgtgaagatgccaacgtggttatctccaccgagaacgccgacgacttcgagaaaaatatgatctcgattcgttgcgaagagcgcctggcgctggccgtgaaacgtccggaagcgtttatctacggttccttcaccgcgcctgctgctggcggcggtgcgtaaaccttaacggcggcctgcgggccgcttttctttttccttaaaggagacagccatgaagctgattgctatcaagcccatctactttgaaggcaaagtgcttactgaaggcaacgagtttgagactctggagcaacacggccgcgacctactggccagcggttacgctcaggagcctggcgagaagaagccggatccggataaagagcaaaagccgaaagggaatggcaaggccaaataaggagcgggcatgctgaccaaagagcaggttaaaacacactgccggatcgacgccgacagcaccgcagaagatatctggatcgaaaccagcatcaaagcggccgccctttacgttcagaagtggacccgacgccgtctttacgaaaatgcagctgatccactgtacctgcttgacccggatgcgctgctttacggcgaagatatcgaaatggccatgctgatgcttatcgcgcactggtacgcgaaccgggaagcggtcatcaccagtggcacctcttcaaccgttgatctggccgttgaatcgttgcttcaaccgtaccgcatttatggtgtctgagaggaatttatggcctgctccggatgcgccgcgcggcgtgaatggcttaaaaagtggatgaaaatcgcctatgaacgatcaacaggtaaaccagttgctgacagcaatggcagcccagacagcagcgatgaaccgactggcggagtcaaacgaggctctgacggcggtgatctaccagtcaatggtagtggaagagagtgatgctgagcttccgcagcatacttacctcagcggcaagcccagggggtaatcatgcaggcggggaagctcaataaacgaatcacgcttcagaaaccagttaaaacgcagagtccagttaccggcgcggtggttaatgggtgggctgaccaggccgagctgtgggctaacgttaccgatttgtctgcgcgcgattttgtggccgcgcaggcgggacagagcgagttaaccacacggatcactattcgctggcgtgatgatgtcacggataagcaccgcattcgttaccgcgggcgcgtttacgatattcagggcgtactggaagacgataaaagcggccgggagtatctgacgctaccctgctcaagaggggttaacgatggctgacggcgttgatttcagcattattggcgttgaggctttgctcggtaagctgtcatcggtcagtgacgatctgcgtcgtcgtggcggccgggctgcgctccggcgcgccggtaacgtgattgttgaaaaagcgaaagcgaatgccgccaggattgatgacccgttaacaggccgcaacattgctgccaacgtggcgatgcgctggaacggccgcctcttcaaaaccaccggcaatctgggttttcggatcggcgttcttcacggtgcagtcctgaaaaaaaatcctgatctcggtgagaatgcgccgacgccacactggcgtctgatcgagttcggtaccgagaatgtgcgggcgcagccgtttatgcgcccggcggccgaaagcagcgtcggtgaggtggttaacgtgtttgccacagaatacgaaaaggctattgaccgtgccctcaagcgcgcggcgaaaaagggagtgccaccatgatcgcccccatatttaccgtctgcgctgccagcccgtcggtggtggcattgctgggcggtgaaacgctgcgcctctatccgttcggccagcaggacgacaatgtggtctatccgtacgtggtgtggcagaacgtcaccggatctccggagaactacctggcccagcgtcccgacgcagactccttcaccctgcaggtggatgcgtatgccgacacggtggatgaggtgatcgccgtcgccgctgcactgcgcgatgccatagagccgcacgcacacatcacacgctggggcgggcaggagaaagaccccgaaaccagacgctatcgctattcgttcgacgttgactggatagtgaagcgataaccctctcaccggccctgagccggtttttttatgaccggagataaaccatgtctgtattaacgcaaggcacgcagctctttgtgcttactaaaggcgcagtgagtgaagtcgaatgcatcaccgctttttcgcctggcagcaaccctgccgatcagatcgaagacacctgtctttctgaaaagaacgatcgtacgtacaagcgcggtctgcgcacgccgggccaggcatcactgacgcttaatgccgatcccaaaaacgtcagtcatatcatgctctacaacctgtccatttctgatgatgaagaagaccaggagctgacatttgcgatcggctggtctgacggggaatcttcgccgacggcggcggcatccggcaccgccggggcagttgatggtctggttctgccggacgatcgcacctggtttgtgttcaagggctacgtaagcgacttcccgtttgattttgcagccaatacggttgtttccacttctgcctctatccagcgttccggctctgccgtctggataccaaaagcgagcgcctaacgcatgaagctgacacttgatgcactgaagcaggcgggggcctttactggccgcccggttgagaaagaaattacctggaaacagggcgacgagcagatcaccgccaccgtctatattcgccccatgggctaccattcagcaatgaccgacgttatggcggctaatggccgggtggatggcgtagccgggcgtattgctgcctctatctgcgacgaagccgggcttccggtatttaccccggcggatattaccggcgaagcggatccggaacgtggtgcgctggatggccccctgactatcgctctgctgcttgccatccaggaggttaacgatctgggaaagagtaccagctcagcgccgaagacgagttctggtgcgagctcgtccttaacggcatcggtggtagaaccatcgccgaagcgcgggaagcgatcagcttcaaagagtcgcagctctgggcaaaataccgggaaagatacggcagcctgaacccgatgatgcggactgagtggggcgctgcgctgatctcctcagtgctagctaacgtcaacaaaggcaaggacgctgcggcatttcgtatcagtgattttgcgccccacatagccgaaacgcccctctctctggaagatgctatgaatgactggaattgataagccaggttgaagttttgtcatcgctcagttccctgttattctttcaaaatcagtgaaaggaggggtgatggcgcttattaaatgtaaggaatgtggtgaggcagtatcaagcaaggcagatgtttgccctaaatgcggggcaccttttaagttaagggtaaaaggtccttcaggatgcatgatgatattgttggttatgattggggttgtttttactttctatttcatagcgaagatgagctaagttaataattgatattaatttgttttgctatgaattaataatttaatcatgcgaatgcaaatatacccgctccggcgggtttttcattttagggctttatatggctggaaaatcactcggcacactaactattgatttaatagcaaaggttggcggattcgtagcgggtatggataaagccgagagatcctcagccaagtggagacggcagattgaaagtgacgctaaggcggcgggttcggctatcctgtcagttggtacggttgccgctggcgcagctgtagcaacagcatctgctggaattgtcctcttaaaaacaatgtccaatcaggtaattgagaccgatcgctgggctaagtccttgaagctttccactcaggaattattagcttggcaatttgctgcgcaaaaagcaggggtttcaggtgaccagatggccgatatcttcaaagatattggagataagattggtgacgcagttttaaataagtcaggagaggcggttgacgccttgaatgctcttggcttatccgctttaaagctttcaaaaataacgccagacaaacaattattagcaataggggaggcgctaagcaagatcgggactaatgctgaaaaaacaacaatattagaaagcattggcaatgacctctctaaattacttcctttatttgataacaacaatcaaaaacttcagcagtttatccaattagcaaaagattatggcgtagccccttctccagaatcaattgatgatcttgttaaagtgaacaatctttttcaagatatggaggcgcaagccagcggcctgaaaatggaaattgctgctggactcgcaaaggtagatttatcacctcttcaaaacggtttggatgacttaaagaaaacgttcacagacccaaaagtgttgcagggtttagctgaaatggtcggtgggattgcgtctttagttgggtggatgggtaaggctgcttcagaattagggcggctggtggagaatttccaaggcggccaacgtgttgctgccaatgcttctcgcagtgaaattgaaagacgaattaaaaaccttgaatcagaccttaacgatcaagggtttcttgctggcgtaaaccgcgtcggaatggacactgaagccaagcagaaagagctaaaagaattacgtgagcgtctggctgatgttaaaaatttccagacttcactaccgactagtccagcaacattcatcgctccagtaagtagtgtttatgcacttggtaatggcgaaactaatggaaagcaaactgcggatgctggtgctaaaaagctagaaaacgccttcaaggctacagagcaaagttaccttcgccagatttcgctgatcgacacaaccggtaaaaaatcagccgaagtgaccgagcagcagaagcttcagtttgatatcgccgatggcaaactgtccgggcttaacgacacacagcgccagcgccttgaacttctggcaacagaagttgatcgcctgaatggagtgaagaaggccaatgaggaaaacctgaaggtcgctcaatatgtggctaatcttcagcgagaaaatgctaactctgcagcttcgttaaatgcggatattgtcggagctgggcagggcgacaaagtgcgggagcgcctgcgtgaacggctggatgtggagcgtgagttcaacgaaaagcgggccgatcttcagcagcgttaccagagtggggacattaaaagccaggtagaatacgatcgctataccgccgagcttgaaaaggcgctttcacagcggctggaaggatatgaaggctactatcagcagattgatcggcttaatgcagactgggtaaccggcgcgcgtgacggacttgctaactgggttgatgactccacaaattatgcttcactggctgcaggcgccatgcaaagcgctatgtccgggatcagcagcaatattgtcgacatgcttaacgacaacaaggccagctggaaagactggggtgtcagtgtgctcaaggtgattgagcaggtaatggttaacatggcaatagccagtgctgttagctcaattggctccctgttcagtttcggggcctcatctgccagctcgactccctcaggagcatacaactcagccgcggcgggaattaagctcaatgctaaaggtggcgtttatgactcagcagatctcagcaagttcagtaatagcatcgtaagcagcccgaccatgtttgcgttcgccaaaggtgctggtctgatgggcgaggccgggccggaggctatcatgccacttacccgtgcatctgatggatcgctcggcgtccgggctctgggcgcagtgggtggtggtggcacgatgttcaacattaatgcccctgtctctatcacccagggtgattcgggtgacgaggtgaataacgcaagcacagccagcaccgccagacagcttgaaggtattgtgcagaagaccctgactgatcgcctgcggaaagaaatatcgccaggcggtatcctttatcgccggacgtgatgttccggttcatttcggaaaacatatggcaatcgatacgtttatctggtgcgttcgcaccgatgcaagtggctcaacgaatgtggccacgctgcaggcacagtttggggatggctataaacaggttgccagcgccgggattaacacggctgccgaaacatggaatttagcgtgtagcgggaaattggcagccatgaagccggtgcgggagtttcttcttagccatgtcatcaagtctttctggtgggtgaatccatggggggagaaaaaactttaccgcgtcaaagctgattctgtcagtcccacattcccgaatggtggttttgttgaaatatcgtttgtatttgagcaggccttcgcgccgtaaattccccgattcattcgataacaggccgcttatgcggccttttttatgggtcttatatgagtttttcaggtgacatccagcaactggagccgggccagcttatccggctaattgaaattgacggtacagctttcggcatagataccgtgctgcgctttcacgcgcacaacattgatccggcaggctgggctgcattcgccgctgataatcttcccgccatcatctggcagggccagcagtacgatccgtacccgtacgagctaaagggcatggagttgtccagcaccggtgcacagccgacgcccacgctatccgtgtcgaatatcggcaactacgtcaccgcgctgtgtctggaatacgacgacatggtcaaagcaaaggtgaaaatacacaccaccctggcgaaatacctcgatgctgcaaactgggtagcgggcaacttgaacgccagcccggcagatgagcgggtgcagctgttttacgtcaacgccaagaccgctgaaacacggatgcaggtagatttcgagctgtgttcacccttcgatgttcagaacctgcaactacccacccggcaaattacgcctgtctgcacctggtgcatgcggggctggtaccgaaccggcaacggctgcgattacgccggaaaccggtattttctgaaagacggcacaccaacgaacaatccggcgctggacgtctgcggtggtcggctgcctgactgtgaagccaggttcggggaaggtaatccgttatcgttcggcggattcccggcggcaaaccttcaggggaaataagcatgcgcaaaaagttaatgaaagccattgctgatcatgtagcagcggaatatccgaatgaagcgtgtggcgtcgtggtgcagtccggacgggcgcagaactacattccgtgtcgcaacattgcaaaaaacccggcggaggccttcacgctggcgccggaagacaggcttgcggcagaggagcagggtgaaatcatcatgatcgttcattctcacccggacgtagtgcaactggtgccgtccgagcacgatcgtatccagtgcgactggtccggcgtggagtgggggatcatgtcctggcctgacggggatttctgcacgctctcgccaagagaagaccgggattataccgggcggcgctgggtgctcggctttgcagactgctggtcgcttatccgtgagtggtaccagcgtgagcacggcgttgccctgggcaattactcggtgccgtatgaatggtgggaacagggcgaaaaccgctacgacgataactggcaggctgagggttttttcgaagttgacccgacggatattcgccccggcgacatgatcatgatgcgcgtacaggcgcaggtgaccaatcatgccgcggtatacctcggcgacaatctcatcctgcatcatatcaccgggcaactttcggcccgggtgccatacggaaaatattaccgcgaccgcaccgttcgggtggtgcgtcataaggagctgataaatgctgaaaatgctcattcttgacgggcgcatggcgaagaaattcgggcgcgtacacaaatttgacgtggcggatctgccagaaatgctgcgcgcgatgtgcagccaggtgcggggatttaagcgctacctgtcagaggggcatatgcatggaattcgcttcgccttcttcaacggtaagcacaatatcggccttgatgaattcgatatgactaatggatcggaggtgtaccggattacgtccatcaccgaaggttcaaagcgcggtggcgtattgcagattgtcatcggtgcggttgcgctggtggcagccttctttaccgcaggcggcagtcttgtcgcacttggcatgagcgcagccgctgccgcagcgaccacgacagcgttaaccggccttggtctgagcatgatgcttggaggcgtggttcagctgctcaccccgcaaccaaaatacaatgtcggcgcatcttccagcacggacaataaacccaactatgcattcggcgcgccggtgaacaccgtggcaatgggctacccggtcccggtgcttttcggtgagcgtgagattggcggggccattatcagtgcggggattttctccagcgatcagcaataacaacaggtgagatatgcgtttactggaaaacgaaaccattcagggcaggaagggcggcgggggcggtaaacagcatacgccagttgagcagccggatgatctgctgtcggatgcgaaactcaaaatgctggtcgtgctgtctgaaggtgaaattcagggcgacctgaccgcgcagaagatttacctgaacgatacggcgctggcgaacgacgacggcagctataacttcaccggcgttaaatgggagtaccgtaagggtacacaggaccagccttatatccagggattgccggaagtggataacgagctgtcagctaacgtggcggtgaccaccaccgtcccatggacccgccagttcagcaatcttacccttgatgccgtgcgcatcaaactcagcctgcccgcacagtacatgtacaaagacaatggcgatatggtcggcaccgtcacgcagtacgccattgacctgtccaccgatggcgcagcatggcgcaccgtagtagacgggaaatttgacggcaaaaccacctctgaatatcagcgcgatcatcgtatcgatctcccggaggcaacaacaggctggtcaatcagagtgcgccgcatcacagcagactccacgtccgcgaaactggtgaacggcttcaaggtcttctcttttgcagaagtgatcgacagcaaacttcgttatccgaacagcgctctgctttatatcgaggtcgacagcagccagttttccggcggcgcgccgaaagtaacgtgcaggcctaagggtaaattaatccgcgttccggacacttacgatccggttacccgcacctatagcgggacgtggtctggcggttttaagctggcctacaccaacaacccggcgtggattttctatgatctggtgctggataaaatttacggcatgggtaaccgcgtcgatgccagcatgattgataagtgggcactttatgccatttctcagtattgcgatgagaaggtgtcgaatggcgccggtggcacagaacctcgcttcacctgcaacgtgttcatccagagccagcaggatgcctataccgtactgagcgatctggccgctgtgttccgggggataaccttctggggaaacgatcagatattcgtgcgcgcggacgtaccgcaggacgatgtggattttgtttaccacgcctcaaatgtgattgacggtctgttcacctacggcagcggcagttataagaaccgctattcatcagcactggtatcctggtcagatccgcagaaccattacagcgacaccgtagaaggcgtgtatgacgaaaaactggttgagcgttacaacgtaaaccagatgtcgcttacggcgattggctgcacgtcacagagtgaggcgcaccgccggggccgctgggctattctctcgaacgcgcgcgacggtaccatttctttcggggtagggcttgatggctacattccgttaccggcggagatcatcggtgtggctgacccgttccgcgccggtaaacagaacggcggccgcatcagcgcggtcagtggccgaaacattacccttgaccgggccgttgactacgcagcaggtgaccggctggtggttaacctgcctgacgggtcggcgcagacccgcaccattggcgctgtcagcagtgacaagaaaacggtgaccgtgaatactgcattcagccagccaccggcggcgggtgcggtgtgggccatcgacagtgacagcctggcgattcagtatttccgtgtgacctccatcagtgcgaacgatgacagtaacggcggctttaccattactgccgtacagcacgacccgaacaaataccggtacatcgatgatggtgtgcgcatcgacccggcgccgatcaccgtcaccccgatcagcgtaatatccgcaccgaaaaacatcatcatcacagaggtggatcatgttgcccaggggctgaacgttgcgacgatgaatgtcacctgggacaaggtgggtggcgctattcgctatatggcccagtggcgcaaggataacggggactggatcaacgtcgccgtcaccagtgcgcagggcttttcaattcagggcatttataccggcagctatgacgttcgcgttcgcgccatgaatgcccaggagtcttcttctccatggggctacgctgatactacttatctgaccgggaaaaccggtaagccaggcacaccgcagaatcttctggcaacggatgatgttgtgtgggcgattgatgtaacgtggtccttcccggatggatcgggtgacacgtcctataccgagctgcagcgcgccacgacggacgacaaagccaaccctgagctgctggcgctggtgccatacccggcagtcagttaccagcacggccccatgcctgccggtgtccgacaatggtaccgcgcgcgcctcgttgaccgtattggaaatgtgggggactggactgcctgggttatgggcacctcttccattgatgtcagtgccatcaccgatgacattctgaatgacatgaaagaatcggaagtatttaagaacctgattgagaacgccgtagacagcaatgaaactattgccggaatggtgacagatattcaggaaaacgccgatcagcttgagcaacaggcgttacaaatccagcaaaactccgatggcctttcacaggcagccgtaaaaatcgacgaaatttccgtttcgatggacggcatgactggcggtgtcaaaaactcatcaattgccgtgatccagaacaccctggcgcaggtgacttcccgcagatcccagactgccaccaataacggtaatgtggcaaaaattgaccggatagacaccaccatagcggataccagccaggctgttgcccgggcgctggttacgcttgatgcgtctgcgggtgggaatgtttcgaacgcgaccgatctgacggaaacgctggctgacttcacccaggcatccgccacgaagattaactctctgacggtgacagtgaacgggcagacggctgccatcaaccagacggcgcaggcggtggcagatgtaaacggcaacctaaacgcgatgtacaacatcaaagttggcgttgccgctaacggccagtattacgctgcaggtatgggcataggggtacaaaatacacccggcggcatgcaatcacaggtaatttttctggcagaccgttttgctgttaccacgcaggccggtgccgttgtatcgctgccattcgtgattcagaacgggcaaacctttatccgtgagaccttcattcaggacggcacgatcaccaatgcgaaaattggcgcatacattcagtcatcaaactatgtcgtcggtaccttgggatggcggatagataagaacgggaccatcgagataaacggtggggtagcaggccagggcaggctggttattacaaataaccggatcatttcgtatgaccagtacggtcgcctggcagccgttatggggcagagagtgtaatgcagacatttatcgctggaaccagctttgatgccatcaactcgatggcggtcaactatgtgatggacgttatcgacatctccggatcgggaagcagaacttacccggccgggtgtacttaccaggccagcctgataatcgaaacggctgtttccgcgcttcccaccaataacccgtatcaggtaaccgtgtccgggaatatcgtttcatggagcgtggcgactccggtccgactggtcgtgctggctacgccaaatactggtaccgacagcagctatttcggccagtcgctgtattcatatgacgcctatggtaacaagacggtaaagctggctccggatttcgtcccgttctgtctggttgacgtcatagacgtgccgcccggtggccagcttattcagacacggatccctgtcagcaataaaatcgtcacgtttcaccggctgccaaacgccgacgggcggttatcgacatccgtttattcggtggtgaattccggtgggtatcatgcattctcgttcaatgcctccggaataaaccaaaccgggtgccgaatttacgttttctcaaactatctggtgaacatcccggattggggatttttcgtttaccgggacgggacgctggtctggcacagtaactgcctgccgctcaatatggggctgatgaccggcgatcttgaatcggcaacgccactggcggtgacaccaggcgtgacatccgtcgtctttatacccgcggatccggcatcgccaaaaagcggcggctatctgaactccagttgttctgccgccggatataaaaacggggtgtggcaggcgacgatagcgaacgtgttttcaagccgcataatctcaggacaagaggccgatgcagtaaagccatgggctattcgtggctatgtcggttacatagactgcagtatctacgaccagtactacccctatgcgctcgggctggtttaatccgtcttacacaacattgcatatacaacccgcttcggcgggttttttattgcccggagaaaatatgatctataacgcaggtacaatctctttcaatggtaattctgtcacaggcacgggcacgaacttcaccgcgccgaccagtcagatccgcatagggcagactttgctggtggcatcaaatccggtgcagctcgttcagataacggccattaacagcgccacttccctgaccgttacgcctgcagcatcaccggctgttagcggccagcgttacggtattctggttacggacagcctgtcagttgatggccttgcccaaagcatctcccagcttattaacgaatatgatgaaaatatcggagcctgggaggcctttgccactacgaacgccaaccagaatgtaacagtcaccatcaacggccagagcgtaatcattcctgcgatgggtaagttgctgcaaaaagggagcaatggcgcgctggcagttaaagacggcggtaccggttcaagtgatgcggcaggcgctcgcacaaacctcggtttaggaaaagcagatggtgtgactttcacgaacctggatctgagtcttaaagggggtagctcaggcatcttgaccctgaaccagttagcaactgattcaaccttttccggtgggagtcggtt

SEQ ID NO: 3 - DNA, 594014 bp, Enterobacter sp SA187
tttgcctggcggcactagcgcggcggtcccacctgaccccatgccgaactcagaagtgaaacgccgtagcgccgatggtagtgtggggtctccccatgcgagagtagggaactgccaggcatcaaataaagcagaaggccatcctcacggatggcctttttgcgtttttatccttcctgatcctgcccacgcatttcatcaatctcgtctaaaatagtcctgtgccattcatccggaggacgttttttgcctaacccgcctttcaactaccaacaggatttcaacagcatcgatttccgcgcgcatccggagctgtaccaggttggccgcggcgagcagggcgtattgcttgtcgagccttataaaagtgagatcctcccgctctggcgctttaaaacccctgaaatagccgcgttgtctgcgcagcaaatcatggaaaagttcgaggagtaccgtcagcaggacgattttgtcggcatggatatggcccgcaaatttattcagatgggctatacccgcgccagacgctacgctaatcaccccggcggaagaaaatacgatgaagataaaaacgttctgccgcgccagaacgaccccataaaagccgaagccgcgaccatcttcaaaaaatactgggataacctgcgcgctgacgaagactatctgcgacgcaaaaaagcccatcagcaaaaatacggctgatcgccagacgcttattccaaacgctacctgaaaatttctcaactggcatatgcaggctcgacatttctgccattcctggttattgtcagctgtctggatgtctaaacgtttatacgtatgctttgaggatttaaggttatgccgattcgggtacaggacgagctgccagccgtcaatttcttacgtgatgaaaacgtcttcgtcatgacgacatcccgtgcaacaggtcaggagatccgcccgctgaaggtgctgatcctcaatctgatgccaaagaaaatcgaaacggaaaaccagttcctgcgattgctgtcgaactccccgctacaggtggatattcagctgctgcgcattgattcccgcgaatcccgcaatacgccagcggaacatctgaacaacttttactgtaacttcgaagatatctgtaatgataacttcgatggcctgatcgtcaccggcgcgccgctgggcctggtggagtttaatgacgttgcctactggccgcagatcaaacaggtgctggaatgggccaaagatcatgttacttcaacgctgtttgtctgttgggcagtgcaggcggcgctcaatatcctctatggcattcccaagcagacccgcaaagacaaactctctggcgtgtatgaacaccatatcacccaaccccatgccttgctcacccgtggttttgatgatgtctttctggcgccgcactcccgctttgccgacttcccggcggcgctgatccgtgactataccgatctggagatcttcgctgaaaccgccaatggcgacgcctatctgttcggcagtaaagacaaacgtattgctttcgttaccggacatcctgaatacgatgctgatacgcttgccggcgagtatttccgcgacgtggaagccgggctgaaccccgacgtgccgtacaactattttccgggcaacgatccgcagcatgtgccgcgcgccagctggcgcagccacggtaatttgctgttcaccaactggctcaactactacgtttaccagatcacgccgttcgatctgcgccatatgaaccccacgctggattaagcgtttcagctcctcttaaagcacctgcgggtgctttttttatttctgaaaaacacttcccggcacgattaaattttaatctgtttgttatcaattggttaatatattattaattaaaaaatggaaattgtttttgattttgtgttttcgttgagtaatcttaaacctgctgaacgaaaactgcacagtctgaatttcatcagcgatgaggatcattctggatcaacaacgaggagccatggcatgacacaacaggcaaccacgactgaagaactggccttcagtcaaccgcatagcgggcaggagcagcagatcctgacgcccgaagcggtggagtttctcagtgaactggtggcgcgctttacgcccaaacgcaacgccctgctggcagcaaggctgcaacagcagctgaaaatagataacggtacgctgcccgattttatttcggaaactgcttccattcgtgaaagcgactggaagatccgcggcatcccggcggatttacgtaacagacgcgttgagatcaccgggccggtcgagcgcaaaatggtgattaacgccctcaacgccaatgtgaatgtcttcatggcggactttgaggactcgctggcgcccaactggcaaaaagtgatcgaaggccagatcaacctgcgtgacgcggttaacggcaccatcagttacaccaatgaaagcgggaaaatctatcagctgaaacccgatcctgcggtgctgttttgccgtgtgcgcggtcttcatctgccggaaaaacacgttacctggcgcggtgagccgatccccggcagcctgttcgacttcgcgctctacttcttccacaaccataaaaacctgctcgccaaaggcagcggcccctatttctatctgccgaaaacccaggcctggcaggaagccgcatggtggagcgaggtattcagctatgccgaagatcgcttcaacctgccgcgcggcaccattaaagccacgctgctgattgaaaccctgcccgcggttttccagatggacgagatcctgcacgcgctgcgcgatcatatcgtcggcctgaactgtggccgctgggattacatcttcagctatatcaaaacgctgaagaactatccggatcgtgtgctgccggatcgtcagcaggtgacgatgaataagccattccttaatgcctactcgcgtctgctgattaaaacctgtcaccgtcgcggcgcctttgcgatgggcggcatggccgcgttcattccgagtaaagatcgtgaacgcaatgagtgggtgctgaacaaagtcaaagccgacaaagagctggaagctaaaaacggtcacgacggcacctggatcgcgcatcccggtctggctgatacggtgatggacatcttcaaccatgcgctgggcgataaccccaaccaactgcacgtcacccgcgacgaagatgcgcctgttaccgccgacgaactgctggccccctgtgacggcgagcgtaccgaagagggcatgcgcgccaatatccgcgtggcggtgcagtacatcgaagcctggatctccggcaatggctgcgtgccgatttatggcctgatggaagacgctgcaacggcagaaatctcgcgcacctcaatctggcagtggatccatcacgaaaaatcgctcagtgacggcacgcccgtcaccaaagcgctgttccgccgcatgctggcggaagagatgcaggtgatccaggaagaactgggtgaacaccggttcagcagcgggcgcttcagcgatgccgcgcgcctgatggagcaaatcaccacctccgacgagctgatcgacttcctgactctgccgggctaccgcctgctggcgtgatccccacataataaaaatggagcatctgcgatgaaaacccgtacccaacaaatcgaacaactacaacaagaatggactaacccgcgctgggagggcatccgtcgcccgtacagcgccgatgaagtggtgaagctgcgcggctcggtgaatccggagtgcacgctcgctcagctgggagccgccagaatgtggcgactactgcacggcgagtcgaaaaaaggctatatcaacagtctcggcgcgctgaccggcggtcaggcattgcaacaggcgaaggcggggatcgaagcgatttatctctccggctggcaggtggcggccgatgctaacctcgcgtccagcatgtatccggatcaatccctctatccggcgaactccgtacccgcggtggtggatcggatcaacaatacctttcgccgcgcggatcagatccagtgggcggcaggcatcgaaccgggggatccgcgctatgtggattacttcctgccgatcgttgctgatgccgaagccggtttcggcggcgtgcttaacgcgttcgaactgatgaagtcgatgatcgctgcgggcgcggcggccgtgcattttgaagatcagctcgcctcggtgaaaaaatgcggccatatgggcggcaaagtgctggtgccgacgcaggaagccattcagaaactggtagcggcgcgtctggcggctgacgtgatgggcgtcccgacgttgctcatcgcccgtaccgatgctgacgcggccgatctcatcacctccgattgcgatgaatatgaccgtgaatttattaccggtgaacgcaccagcgaaggcttttaccgcacacgggcaggtattgaacaggcgatcagccgcggccttgcttacgccccttatgccgatctggtgtggtgcgaaacttcgacgccggatctggagcaggcgaagcgttttgccgacgccattcacgcccgcttccccggcaaactgctggcctataactgctcgccgtcgttcaactggcagaaaaatctcgacgacaccaccatcgccagcttccagcagcagctggcggagatgggctacaaataccagttcatcaccctcgccggcatccacagcatgtggttcaacatgttcgacctggcccatgcttacgcgcagggcgagggcatgaagcattatgttgaaaaggtccagcagccggaattcgccgctgcgaaagagggttacacctttgtgtctcatcagcaggaagtgggtaccggttacttcgacaaggtgacgaccattattcagggcggcacctcctccgttaccgcgctgaccggttcgacggaagaacagcagttctgacgtcctgtagcccggtggcgcgaggcttaccgggcctgcggatcctgtcgttgtgcaggccggataagcgaagcgccatccggcaatcccaatttcggacgagggcaaaagatgtcccgtgacctggaactgttaatcgcccagaccattctccagggttttgacgcgcagtatgggcgcttcctggaggtcacctccggcgcgcagcagcgctttgagcaggcggactggcacgccgtgcaacaggcgatgaaaagccgtatccatctctacgatcatcacgtcgggctggtggtcgagcagttacgctgcattaccgataaccagacgctcagcgccggatttctgctgcgcgtcaaagagcagtacaccgccttgctgcctgattatccgcgtttcgaaatcgccgaaagcttctttaattctgtctactgccgcctgttcagtcaccgtcagctgacgcccgaacggctgtttgtgttcagctcacagcccgcgcagcgcctgcacgttacgccgcggccgctggcgaaagactttacgccgtattacggctggcacgcgctgctccataacgtgctggaagatctacccctgcggctgccgtggcaggatcaggcgcgtgatgtgggttatatcgtggcgcatctgctggaaaatttcggtgaagcgcggttacgtcaggcgcgtttgcagatcgccaacgaactgttttatcgcaacaaggccgcgtggctggtgggaaagctgatcctgcctgacgccaccgtgccctttttactgccgatccaccgcgcggacgatcaccggctgttcgttgatacctgcctgaccaccagcgccgaagccagcatcgtctttggcttcgcccgctcctactttatggtttacgccccttttcccggcgcgctggtggaatggctgcgggagatcctgcccggtaaaaccaccgctgagctgtatatggcgattggctgccagaaacatggcaaaaccgaaagctatcgggaatatctgcactatatcgctgacagcgacgagcagtttgttgaagcgcctggcattcgcggcatggtgatgctggtgttcaccctgccgggattcgatcgggtgtttaaggtcattaaagatcgcttcgcgccgcaaaaggagatggacgccgcccatgtgcgcgcctgctaccagctggtcaaggagcacgatcgcgtcggacgcatggccgacacccaggagtttgaaaattttgtgctggagaagcggcggatcgctccggcgctgatgacgctgctgatggaggaagcgccgggcaaaatcaccgaccagggggataatatcgccatcagtcatctctatattgaacggcgcatggtgccgctgaatatctggctggagcaggtggacggtcaggcgttgcacgacgccatcgaagagtacggtaacgccatccgccagctggccgccgccaatattttccccggcgatatgctgtttaaaaacttcggcgtaacgcgccacgggcgggtggtgttctatgactacgatgaaatttgctatatgacggaggtgaatttccgcgacattccgcccgcccgttatccggaagatgagatgagcgctgagccatggtacagcgtggcgccgggggacgtattcccggaggagttccgccactggctgtgcgccgatccgcgctgccgggtgctgtttgaagaattgcacgccgatctctttcgcgcggagtactggcgcgggttacaggaacgcattcggcagggctatatagaagacgtttacgcctaccgccgtcgccagcgtttcagccagcgttacggggcggggtgacaggccgggtattatgcaattgtggtatttgtaggccgggtaaggcgtagccgccacccggcatctcttggttgcaacaccacattaccgtgtgccgccgtacgccagcgtcacttctttcgccgctttgatcaccagcgcgcccagctccgtcacgcggtcatcggtaatgcgcgaaatcggcccggaaatggagatcgccgcaaaaggttcgcgatgctcatcataaatacaggccgccacacagcgcaggccgagtgcgtgctcttcatcatccagggagtaaccgcgcttgcgcgtctgggccagatcttctttcagatgcagcggcgacaccagggtcgcatgagtatatgcatgcagcccctggcgatgcagcagcccggtgacctgctcttcagaaagctgcgccagaaaggctttccccgcgccggacgcatgcatcggcagcttaccgccgatcggcgctgacatgcgcattaactgcgtgcactgtacctgatcgataataattgcctgatgatcgctctggtcgagcaccgccagattcaccgtctcgccggagtcttccatcagcttgcgcagaatgggatgcacaatcgccagcagattacggctttgcaaaaaactgctgccgataacgaacgcgtgtgcgcctacagcccagtgccccagctcacccacctgacgcacaaagcccagctgctgcatggtggtcagcaggcggtgcgtcgtggagttcggcaggccagcctgctgcgccagctcggtcagcgccacgctgccgtgggattcagcgatccactccagcaacttcaggccgcgcgtcagcgactgcacctggccggtggcctgttgtgcagcggcgggggcgggttttcttccgcgtttggcgggaacagtggcaaccatagctgactccttttctgtatcgtggaaatcattttcgttttatttgattatattgcaaccatcctcttactgatcggaggagtggttatgaacatgtctcatgttcagcgctgttctcttttccgccacaggggattgtgccagtatggtctgctggcctttctggcctggttgagcgtcgtcaggagcactcgtgagcagcaaagttgagcaactgcatcagcagttaaaaaaacgcattctggttctggacgggggcatgggcaccatgatccagggctatcgtctgagtgagcaggatttccgcggcgaacgtttcgccgactggccctgcgatctgaaaggtaacaatgacctgctggtgctgagcaaaccggaggtgatcaccgccatccacaacgcctattttgaggcgggcgcggacatcattgaaaccaacacctttaactccacgacaatcgccatggcggattaccagatggaatccctgtcggcggagatcaaccgcgaggcggcgaaactggcccgcgcctgtgccgatgaatggacagcccgcacgcctgacaggccccgctatgtggcgggcgtgctcggcccgaccaaccgcacggcgtctatttcgccgaacgtcaacgatccggcgttccgtaacatcactttcgatcagcttgtcgaggcctaccgggaatcgacccatgcgctggtggagggcggcagcgacctgatcctcatcgaaaccgtgttcgacaccctgaacgccaaagcagcgattttcgcggtgaaagccgaattcgacgcgctgggcattgagctgccgatcatgatttccggcaccattaccgacgcctccgggcgcacgctgtccgggcagaccaccgaagccttctataactcgctgcgccacgccgatgcgctcaccttcggcctcaactgtgcgcttggcccggatgaactgcgtcagtacgtgcaggagctgtcgcgcatcgcggagtgctacgtcaccgctcacccgaacgccgggctgccgaatgccttcggcgaatacgatctcgacgccgacaccatggccacgcagatccgtgaatgggccgaagcgggctttctgaatatcgtcggcggctgctgcggcaccaccccggaacacattgccgccatggatcgcgcggtggcgggattagcgccgcgcgccataccggagttgccggtagcctgtcgccttgccgggctggagccgctgaacatcggtgccgacagcctgtttgtgaacgtcggcgagcgtaccaacgtcaccggctctgccaaattcaagcgcctgatcaaagaagaaaaatataacgaagcgctggaagttgccctgcaacaggtggagagcggcgcgcaaattatcgacattaatatggatgaggggatgctcgacgccgaagcggcgatggtgcgtttccttaacctgatcgccggcgagccggacatcgcccgcgtgccgatcatgatcgactcctccaaatgggaggtgatcgaaaaaggcctgaaatgcattcagggcaaaggcatcgttaactccatctccatgaaagagggcgtcgaggcctttattcatcatgcgaaactggtgcggcgctacggcgcggcgatggtggtgatggcgttcgatgaagtcggccaggccgacacccgcgcgcgtaaaatcgaaatctgccgccgggcctacaaaattcttaccgaagaggtgggtttcccgccggaagacatcatttttgacccgaatatcttcgccgtcgccaccggcatcgaagagcacaacaactacgcgcaggactttatcggcgcctgcgaagacattaaacgcgaactgccgcacgcgatgatttccggcggcgtgtcgaacgtctccttctccttccgtggcaacgatccggtgcgtgaagccattcacgccgtattcctctattacgccatccgcaacggcatggacatgggcatcgttaacgccggacagctggcgatttatgacgatctgcccgctgaactgcgcgacgcggtggaagacgtggtgcttaaccgccgcgacgacggcactgagcgtctgctggatctggcggaaaaataccgcggcagcaaagccgacgacggcgcgaacgcgcagcaggccgagtggcgcagctgggacgtgcgtaaacgtctcgaatactcgctggtcaagggcatcacggagtttatcgaggcggataccgaagaagcccgccagcaggccgaacgccccatccaggtgattgaaggtccgctgatggacggcatgaacgtggttggcgatctgtttggcgaagggaaaatgttcctgccgcaggtggtgaaatccgcccgcgtcatgaaacaggcggtggcctggctggagccgtacatcgaagccagcaaagagaaaggcaaaaccaacggcaaaatggtgatcgccaccgtgaagggcgacgtacacgacatcggcaaaaatatcgtcggcgtggtgttgcagtgtaataactatgagattgtcgatctgggcgtgatggtaccggcagagaagatcctcaaaaccgcccgtgaagtgaatgccgatctgattggtctgtccggcctgatcacgccgtcgctggacgaaatggtcaacgtggcgaaagagatggagcgccagggctttaccattccgctgctgattggcggcgccaccacctccaaagcgcacaccgcggtgaagatcgagcagaactacagcggcccgacggtctacgtgcaaaacgcctcgcgcaccgtgggcgtggtgtctgcgctgctgtccgacgatcagcacgacgattttgtcgcccgtacccgcaaagagtacgaaaccgtacgcattcagcatgggcgtaaaaaaccgcgtaccccaccggtgacgttacaggcggcgcgggaaaacgatctggctttcgactgggagagctataccccgccagtagtgcatcgtcccggcgtacaggaagtcagcgccagcattgagacactgcgtaactacatcgactggacgccgttctttatgacctggtcgctggccggaaaatacccgcgcattctcgaagatgaggtggtgggggaagaggcgcagcgcctgtttaaagacgccaacgacctgctggataaactgagcgccgaaaaatcgctcaatccgcgcggcgtggtcgggctgttcccggcgaaccgggtgggcgatgacgtggaaatttaccgtgacgagtcccgcacgcaggtgctgaccgtggcgcaccatctgcgtcagcagaccgagaagatcggctttgccaactactgcctcgctgatttcgtcgccccgaaactcagcggtaaagcggattatatcggcgccttcgcggtgaccggtggcctcgaggaagacgcgctggccgaggcctacgacgcgcagcacgatgattacaacaaaatcatggtcaaggccgtcgccgaccgtctggcggaagcctttgccgaatacctgcacgagcgggtgcgcaaagtgtactggggctacgcgccgaacgagaacctcagcaacgaggagctgatccgcgagaactaccaggggatccgcccggcaccggggtatccggcctgcccggagcacaccgaaaaaggtaccatctggcaactgttggacgtggaaacccacaccggtatgaagctgacggaatccttcgccatgtggccgggcgcgtcggtatcgggctggtacttcagccatcctgacagcaaatactttgccgtggcgcagatccagcgcgaccaggtggaagactacgccctgcgcaaagggatgacggtaacggaagtggagcgctggctggccccgcatctgggttacgacgcggattaaccctgtcatatttggttaataataaacaaggcaccttccgggtgccttggcactttattacatttaagaccttatacttacctgagtgaactcacctttccccacgggagaagaggaggagaaaggaaaccaacaatactcaggaggcaaccattccgtgttaacgctgttacacctgttatccgctgtcgccctgctggtctggggaacccatatcgtgcgcaccggcgtcatgcgcgtgttcggcgcgcggctgcgtaccgtactcagccgcagcgtggaaaagaaaccgctcgccttctgcgcggggattggcgtcaccgcgctggtacagagcagtaacgccaccactctgctggtgacctctttcgtcgcccaggatctggtggcgctggccccggcgctggtgattgtgctgggcgcggatgtcggtacggcgctgatggcgcgcgtgctgacctttgatctttcatggctgtcgccgctgctgatatttatcggcgtgattttcttccttggccgcaaacagacgcgcgccggacagatggggcgcgtgggtattggcctcgggcttattctgctggcgctggagctgatcgtacaggcggtgacgcccatcacccaggccaacggtgtaaaagtgatttttgcctcgctgacgggcgatctgatgctggatgcgctgataggcgcaatgtttgcagtgatcacctattccagtctggcggcggtgctgctgaccgccacgctgacggcggcgggggtgatcgctttcccggtcgcgctctgtctggtcattggcgcaaacctcggctccggcctgcttgcggtactcaataacagcgctgctaatgccgccgcccgccgggtggcgatgggcagcctgctgtttaagctggtgggcagcctggcgatcctgccgtttgtgcatctgctggctgatgccatggaccggctgccgctgccggagtccgagctggtgatctatttccacgttttctacaacctgatccgctgcctggtgatggtgccttttgtcgggccgatggcgaatttctgtaagcgtattattcgtgatgagccggagctggatgcgcgcttaaaaccgaagcatctggataccagtgcgctggacacccccgcgctggcgctgtccaatgccgcgcgcgaaacgctgcgcatgggcgacgccatggagcagatgctggtggatttcaaaaaggtgatgcacggcgagccgcgtcaggaaaaagagctgcgtaaaacggcggatgacatcaacgtgctttacaccgccatcaaactctatctggcgcgtatgccgaaggatgaactggcggaagaggagtcccgccgctgggcggaaattattgaaatgtcccttaacctcgaacaggcgtcagacattgtcgagcggatgggtagcgaaatcgctgataaatccctctccgcacggcgggcgttttcgctggaaggcttaaacgaactggacgcgctgctggagcagttgctcagcaacctgcaactggcgatgtcggtattcttttccggcgatgtgcccagcgcccgccgcctgcgccgccgcaaacaccgtttccgcatcctcaaccggcgctactctcatgcgcacgttgatcggctgcatcagcaaaacgtgcagagtatcgaaaccagttcgctgcatctggggctgttaggcgacatgaaacgtctgaattcgcttttctgcgcggtggcctacagcgtgatggaacaaccggatgaagacgacgagcgcgacgagtattaatattttctctgtgccggatagccatgctgtcctgctcagccaaagagttcactgtgcgtaccgagatcgataaaggtgaccaggttttgggtgtcatcaagccggtaaaccagcaggaaatcacccccgatatgtaactctctggcgcctgcccattccgccccgttcagttcatgatccagatattcagcaggcaatgtggtctgacagaaaatgagtgacatcacgtctgcaacatcatgcatattacgtcggccagctttgttgtaacgtgcccaggactttgcaaaagtgcgggtatattccacccggcgagggagtttacttctcttgtgattcatcgtcgttcagtcccttgagcatatcgtccatcgacgtaaagcgatgacttgctttcgtttcgatctccgttgcttcctgcaacgcgattttcattctggcagaaggtcgcttaacctcaaacgggatgccctgatggctgaccacctgttcaaggaaaaggcgaacggcgctgcttaccgtaagtccacagtcgcgtaatacctgactcgcttcatttttcagctcctcagaaatacgcattttaatgctggtttgcataaatctattctccacaaagttgtgggtacattgtgggggcgcagcgcttatttttcaagcattgctctgctaacgagaaacctgtgacctcacaaagccattttttctgacgcggcaggtaaggtatattccgcttttacaggagaatttatgctgccagactcatcaacccgattaaacaaatacattagcgaaagcgggatctgctcgcgtcgcgaggctgaccgttacatcgagcagggaaacgtctttattaacggcaaacgcgccgctattggcgaccaggtctctcccggcgatgtggtaaaagttaacggtcagttgattgagccgcgggaagcggaagatttggtgtttatcgcgctgaacaaacccgtgggtatcgtcagcaccacggaagacagcgaaaaagacaacattgtggatttcgtgaaccacagtaagcgcgttttccccatcgggcgtctggataaagactcgcaggggctgattttcctcaccaaccacggcgatctggtgaataaaatcctgcgcgccggtaacgatcacgaaaaagagtatctggtgacggtcaacaaactggttaccgatgagtttattcgcggcatgggcgcaggcgtgccgatcctcggtacggtaaccaaaaagtgcaaagtcaaaaaggaagcgccctttaccttccgtattacgctggttcaggggctgaaccgtcagatccgccgcatgtgcgaacatttcggttatgaagtgacgaagctggagcgcacgcgcatcatgaacgtcagtctcagcggcttaccgcagggggagtggcgcgatctgacggacgatgagctgattggcctgtttaagctgattgaaaattccagttcggaagcaaagccgaaaggaaaagccaaaccgaagacccagtccgcgaaagcgcctgcggctaaagccgcgaagcccgacgacaaaagccgggcgaaacctgccggcaaacgcttcgtgcagccgggtcgtaagaaaaaagggcgctaaaccctaacgcttgccgcgcgtggaggtattggcagaccaggaataggtcgcctccgcgtccggtttataggctttttgcttcttcgcctgtcgcgcctttttggccgccgcttcacgctccgccatcagtttatcgatgtactcttttttcacatgattggtttcagaattggtgagcagacgcccgtgtgatatgcgtgcgcggtcgagcagtgttttcagctcgcgctgttcactttccgtcatatcttgttgtgtcagtcttgcaatagccatggtgacgatctcctggggaaagtgccacgagtgtacgtgatgaacgcgatccatgcagtaaccttcgtcgcacaaaaaaatgccgggtaaaaacccggcagcaaggcgtgataaacgacagcagcactcttactcaaacaaattgtgatgcagtttctgcacgacctgctcagcctcgccgcccggcaccaggaagcacaggttatggctggatgcgccatagcaaatcatgcggatattgaacggctccagcacgccaaacacctctttgcccacgccgcaggctttcgacagatcgttgccgatcagcgctaccagcgcgagattttcttccacttccacgcggcacagggcagacagctccatcagcagtgactgcgtcagcagcgtatcgccggtggaggtggagccggtggtgtccagcgtcagcgccacgctgacttcggaggtggtgatcaagtccacggaaatattgtgacgggcgagaatgccgaatacctccgccaggaaaccgcgggagtgcagcatgttcaggctgtgcagggtgaccagcgtctgcttacgacgcagcgccagcgcgcggaacagcggcgggttttgcgtttcattgcataccagcgtgccgcctgcctgcggatctttgcttgaaccgacaaacaccggtatatcgctgcgcacggcgggcagtaaggttgccgggtgcagcactttcgcgccgaacgtcgccatctcggcggcttcttcaaaggcgatttcgtcgatgcgttttgccgacggcaccacgcgcggatcggtggtgtaaatccctggtacgtcagtccagatgtcgacgcgggtggcgtgcagcgcttctgccagcagtgccgccgtgtaatcgctgccgccgcgaccaagcgtggtggtacggcctttggattcgctgccgataaagccctgggtgatcaccaggccttcttccagacgcggcgcaagctgttgtttcgccagctcggccagcgcggcgacgtccggctcggcacgaccaaagcggtcactggtgcgcatgattttacgcacgtcaaaccagcgggcgtcgacgttgcgctcacgcaggatctccacgaacagcagggtggacattaattcgccatggctgaccagttcatcggtcagcgcggtagaggtagccagcgacgccgcttccgccagcgtggtgatgttttccagcaggcggtcgatttcctcgcggatgacgttcggattgcgcatacgctccagaatgtcgaactggattttgcgaatggcgtccagcttcacgaagcgctcagtggcttcaagcccctctgccagcgccaccagcaggttggtgacgcccgctgacgctgagagcaccaccaggcgcacgctgtcgtcagagagcaccacatcggcgctgcggttcatggcatcaaaatcggcaacgctggtgccgccgaatttggcgacgatgagcggggatacagcttctgtcataacgacctcgtgtcagggagagaaaaagcgaccatggcacaagggcatatcgaaaaccggtgctggcgcaaataccgtatttataaataaaaggtgcggcgggcagtgtcaacgccgggattatgcggattattcatgttatccagccgcccaggaaattaacttataacggctatactttgcgcgggccttcctcttaacgcgacgatccccattacacaaaaaccatcacaatttttgtgcgcaggcgctacaatcgaccgcagttaacattctcaaatcagaagagtattgccatgaaaaacattaacccgaagcaaacttctgcctggcaggcactgcaaaaacactatgaggcgatgaaagatgtgaccatcgccgagctcttcgcgcaggacagcgatcgtttcgcgaagttctccgccacctttaacgatcagatgctggtggatttctccaaaaaccgcatcactgaagaaacgctctccctgttgcaggatctggccaaagaaaccgatctggccggcgccatcaaatccatgttctccggtgagaagatcaaccgcacggaagatcgcgcggtgctgcacgtcgcgctgcgtaaccgcagcaatacgccaattcttgttgacggcaaagatgtgatgccggaagtaaacgcagtgctggaaaaaatgaaagccttctcggaagcgatcatttccggtagctggaaaggctacaccggcaagccgatcaccgacgtggtgaacatcggtatcggcggctccgacctcggcccgttcatggtgaccgaagcgctgcgcccgtacaaaaaccacctcaacatgcactttgtctctaacgtcgatggcacccacatcgcggaagtgctgaagaaagtgaacccggaaagcacgctgttcctcgtggcgtccaaaaccttcaccacccaggaaaccatgaccaacgccctgagcgcgcgcgaatggttcctgaaaaccgccggcgatcagcagcacgttgcgaaacacttcgccgcgctctccaccaatgcgaaagcagtaggcgaatttggtattgataccgccaatatgttcgagttctgggactgggtgggcggccgttactccctgtggtcagcgattggtctgtcgatcatcctgtccgttggctttgacaactttgtggaactgctgtccggcgcgcacgcgatggataagcacttctccaccaccgcgccggagcaaaacctgccggtcctgctggcgctgatcggcatctggtacaacaacttcttcggcgctgaaaccgaagcgatcctgccgtacgaccagtacatgcaccgttttgccgcgtacttccagcagggcaacatggaatccaacggtaagtatgttgaccgtaacggtaatccggtggactaccagactggcccgatcatctggggtgagccgggcaccaacggtcagcacgcgttctatcagctgatccaccagggaaccaaaatggtgccgtgcgatttcatcgccccggcgatcacccataacccgctgtccgatcaccatccgaagctgctgtctaacttcttcgcccagaccgaagcgctggcgtttggtaaatcccgtgacgtggttgagcaggaatatgccgaccagggtaaagatccgaagacgctggagcacgtggtgccgtttaaagtgttcgaaggcaaccgcccgaccaactccattctgctgcgtgaaatcacgccggcaagcctgggtgcgctgattgcgctctatgagcacaaaatcttcacccagggcgcgatccttaacatcttcacctttgaccagtggggcgtagagcttggtaagcagctggcgaaccgcatcctgccggagctgggcgatgaaaaagaaatcagcagccacgacagctcaaccaatggcctgatcaaccgctacaagtcctggcgtaaataaggcattgcaggcccgtgcaggcgtagcgtcgccgggctatttaaaaatttctatctatactaaaagccgatattagtatcggcttttcttatcggataattcccgttgtctgtgccttgccgcaaattcctgtattgagtttaatctgaaaatccagaatgacctgttattacctgagggttattttaggataatacgcagctaaaatcatcagtacctctattttatccttttgattttaaatatattaaaattaagtgaagcggtttgaccgcaggccattgtccaattatcttaaaaccctgtggctatttccctgctacgtaattcgcctgccttagttgtgtatactcgatcgcgcctgagtctctctcgggtaaaaaatccattcattcaatgaagggaaattgatatgcgtaaagtcctgtatggcatttttgccatttcagcgctggcggcgacgtctgcgtttgcggcaccggtgcaagtcggtgaagctgcagggtcggctgcaacgtcggtatcggcgggcagctcgtctgcgacaagcgtcagcaccgtgagttctgcggtgggtgtcgcgctcgcagcgaccggcggtggtgatggatccaataccggaaccaccactacaacgaccacaagtacccagtaatcgggggtacattaaccataaccacacttcggtgtggttattttgaccctggagaattgttgtgaagcgagccggaattgttctgctttgtctgttgcttcaggcgtgctccggcacgaccaaaggactgggaagcgcgctgtgggatagcatgttcggcacccctggcgtccatctcacggatgaagacatcgcggacatgccctacgcgagccagtacatgcagctcaacggcggaccgcagttatttgtggtgctggcgttctcagaaaacggccagctgaaatgggtgacgcaggatcaggccactatcgtgactcagcatgggcgcatcgttaagaccctgatcggccaggataaccttatcgaggtgaacaatctcgccgccgatccgctgaccaaacccaatcaggtgcgggacggcgcaagctggacgcggacgatgggctggacggaacacggccaggtgcgttacgccaccgcgcaatcgaccttccgctgggcgggcaccgacaccctcgcgcttggcagcgatgtcaccgacgtccgcgtgctggaagaagaagtgaccaccgatcaaaaaacatggactaaccgtttctggatagacagtgaagggcaaatcaggcagtcaacccagtatctgggcgctgattatttccccatcaacactatgttgattaaggctgcaaaagaaaaatgaaggcacttatcacatcgttacttttaaccctgatgcctccgctggcctttgctgcgggcactatcaaggtttattccccggacagcacacagccgaaaacattaaccgatgccccttttctgattgatttagtcgggcagccccggctggcaaacagctggtggccgggcgcggtgatcagcgaaggcaaagccacggtgattgccgaacagcgtcatcaggcgctgctggcgcgtcttggcgcgctggcgagtgaagaagagggcgacgatgccgccgcaatcaacagcgtgcgccgtcagttgcaggcggtgaaagtgaccggacgtcagctggtgccgctcgatccggatcgggtacgcgtcgaacctacggccaaccgtccgctggaaggtgagtacacactgtgggtggggccacagcctgctacggtgatggtcgcggggcttatcagcagccccggtaagaagccctttcagcccgggcgcgatgtggcgggctatcttgatgacatgagcctgctcagcggcgcggaacgtagctatgcgtgggtgatttatcccgacgggcgaaccgagaatgtgcctgtggcgtactggaaccggcggcatgttgagccgatgccgggcagcgtgatcctggtcggctttgccgactcgatctggagcagccagtacgaagaaattaacgccgatattctttactccctcacgcatcggatcccggattaatgaaaaaaatctatctctacagtctgctggcgctgggggtgaacgcggcgtgccatgcagaaacctatccggcccccattggcccgtcgcagtccgattttggcggcgttggcctgttacagacgcccacggcgcgcatggcgcgtgaaggcgagatcagcctcaactatcgcgataacgatcagtaccgctactattctggctcggtgcagcttttcccgtggctggaaaccactctgcgctacaccgacgtgcgtacccgtcagtacagcagcgtggatgcgttttccggcgaccagacttacaaagataaagccttcgatttaaaactgcgcctgtgggaagagggctactggctgccgcaggtggcggtgggcgcgcgcgatatcggcggtaccggcctgtttgacgccgaatacatcgtggcgaacaaagcctggggaccctttgatttctcgctcggcctcggctggggctatcttggcacctcgggcaacatcaaaaacccgctctgtacctacagcaataaatattgcgtacgcgataacagctacaatcaggccggctcggtggatgccagccagatgttccacggaccgacttcgctgttcggcggcgtagagtaccagacgccgtggcaaccgctgcgcctgaagctggaatatgaaggtaacaactacgagcaggacttcgcgggcaaactgccgcaacgcagcaacttcaacgtcggggcgatttatcgcgtcaccgactgggccgacgtcaacgtgagctatgagcgcggcaacaccttcatgtttggcgtcacgctgcgtaataactttaacgatttgcgcccaagctataacgataacgcccgtccgcaataccagccgcagccgcaggacgccatcctgcaacattctgtggtggcgaatcagctgacgctgctgaaatataacgcgggccttgcggatccgcagattcaggtgaaagacgataccctgtacgttaccggcgagcaggtgaaataccgcgactcgcaggaagggatcgagcgcgccaaccgcatcatcatgaacgatttgccggacggcattcgcaccatccgcgtgacggaaaatcgtctgaacatgccgcaggtgaccactgaaaccgacgtcgccagcctgcaacgccatttacagggcgagccgctgggacatgaaaccgaactggtgcaaaaacgtgttgagccggaggtgccggacaccaccgagcagggctggtatatcgaaaaatcccgtttcgattttcatatcgatccggtactcaaccagtccgtgggcggcccggaaagcttctacatgtaccagctgggcgtgatggcgactgccgatctgtggctgaccgaccacctgctgaccaccggcagtctgttcggcaacatcgccaacaactacgacaaattcaactacaccaacccgccgaaggattcgctgctgccgcgcgtgcgtacccatgtgcgtgattatgttgaaaacgactactacgttaacaacatgcaggccaactacttccagtatctcggcaacggcttctacggccaggtgtacggcggctatctggaaaccatgtacggcggcgcaggcgccgaagtgctgtggcgtccggtggacagcaactgggcgttcggcattgatgccaactacgtgaagcagcgtgactggcgcggtccgaaagagatgatgaaattcaccgattacagcgtgaaaaccggccatctcaccgcctactggacgccgccgttcgcgcaggatgtgctgatcaaggccagcgtcgggcagtatctggcaggcgataagggcggcaccctggaagtggcgaaacacttcgacagcggcgtcgtggtgggcacctatgccaccatcaccaacgtgtcgcctgaagagtacggcgaaggcgacttcaccaaaggcgtctatgtctcgataccgctggatctgttctcgaccggcccgacccgcagccgcgccggcatcggctggacaccgctgacgcgtgacggtggtcagatgctgggccgtaaattccagctgtatgatatgaccagcgatcgctccattaacttccgctgattccccccttaaattgtccctctcccgaccgggagagggcatttctctgtaactttaaaagaaatcctgcttttgtgatttacgtgattatgttcacaatgattaaacgtttaatcatttagcataagtggcgttcatggagttaattgataaacatgatgtcattcattgttaacgtatccacagggttggtgggcttttctatgaaaaaacaaaccattcatttctttcagatgttatcccgcgcttttattactcccgttgcgcttctgtcttttgcttcattgttgctgggcgtcgcctcgttgtttctctggcatgaaaaactacgtgaattgctgccgtttttaaattctgtcgtatttcagtatgtcgctaatctgcttaatactgtgggcgcggtaataatggataatttgcccttattatttgcagttacgctggcctttacgcttgcgaaagcagagaaagaatatgcggcgctgggcgcgctatgtggttatatggctttgctgatgggtatgcatgtgctgattacagtcaatcctgcggtcaacgagatgtttacgaaaagcgcgctgacgaccacgctgggtattgaaacagtcaacacgggcgtggtaggcggtattattaccggtctgctctccgcaataattcataatcgtgttcatcagataaaattcccggtggcgctggcttttttcggcggcgtcaggttcgtccccctcgccaatattatgtttttcgtggcctttggtcagtgctttccttttttatggttgatgctttccaaagtgataaaccatgcggcaatgggcatctccagcgcgggtgtttttgcgccctttatctatggtctgggagagcgattactcctgcccacaggactgcatcaaatctggaatacggtcatcagggatacgatggtttccggtatcgctatttttcctgacgggcacacggtggaaggcgcaagagcgatttttgcggaatacctgaaaaccaacaccctaccggtcaatatgacgctggcggacatcgttaaattcctgcgcggtgggcagatcccgataaccatgttcaccctgccgatgatggcgctggccatgtaccagacggcgaggccagagcagcgtaacaagatcaagccgttactggtgaccggcgcttttacctccattatcgccggtgtgactgaacctctggaattcacctttcttttcgtttcaccggtctggtatctgatctattccgtcattaacggcttaagctggatgttctgttatctcttccagagtaatttaggcggcaccgaagccaatattattgggctggtactctatggcttcctgcgcccggaatcgacattctggataaacatgttgattggcatcgtctttagtcttgcaggttatacgctgttccgcttctggatcgtgcattttgatttaaaaacgccgggccggggcagcgactatgaacagacgatcgatattctggggatcaatcagcaacaggatgacatatcaaacgatccgctaaaactaaaagcgttagcgataatccggggcttaggcggaaacaagaatattatcagcgtcgattgttgctatagccgcctgagggtaagcattcatgatatttcgctggtcgatgaacacattattcaggcaacgggcgcattaggttatgtgccggttgatgacggaaacgtgcaaattgtttacggcaccaccgtcgatactattcgtaacgcagtcaggaaattactttaaaggagcaatcatgcaaatccatctggtaaaagattataacgcgatgtcggcttgtgcgtttgacattattgccaatactcttcgccaaaaatccagcccggtgatctcgctgaccaccggcgcgacacctgccggactttttaaattgctggtgaaggcgattaatgctggcgacattgatatttcaaataccgttttcctgaatattgatgagtatgtcggtaaccagcgtgatgtgtataccgttcatacctttatgtttgaacgtctgtataaccagttgacgcaaaagcccaaatacttcgacatgtttaatgcaggtacccttaataaggactatgaaattctgcgttataaacacattctcgacacctatccgcgggatattcagttaatggggctgggcaccaacgggcacattggcgcctgcgagccgggcacgcccttcgatgccagcgcgttctgcgctgaacataaggcatcgacggttgaaagcaccatgaagctctacaacattacgcgcgaacaagcgccgactcacatgttcacgctgggcttcagggaaattatggctgccgacaggccgttgttgatcgtcagcggtaccagcaaagccgacgccgttcgccgtctgcttgaggagccgatcaatgagtcctgcccggcatcctttctgcgtaatcatcccaacttcactctcatccttgatgaagaggccgcctcacaactgcgtaaggaaacgctggaatgggcaacacgttaattgctacctggcgcatggcgctggaagggctggctgaagcggcagagataagtgatgtgaagaacgctgttctgcatgcggtccgtaaggttgaagacaatcccaggctgcattccgtcggctacggtggtttaccggcagaaaacggtgaggtcgagctggatgcagcctttatggatggcgatacgctaagctatggcgcggtggcggcggtacgcgatcttaaaaatcccattatggccgcgcattatcttagcggcctgcaacgcaataacgtgctctgcgggacgggggctttccatgtcgcggtcgggcagggaatggagacgcgggataacacttattcgctggcgcagcagaaatggcgcgccgcgctacaggcttcgcccggcccgctaccgctggaagcctacgatggtcacgatacggtgtgcattctgggacgcgcgcctggcgggtcggtttgcgctggcgtgtcgacctcgggattatttatgaaaaaaccggggcgcatgggggattcaccgattattggctccgggtgctacgccgatagcgcaacgggcgcggcggcggcaaccggcgtcggcgaggatattatgaaaggctgcctttcatgggaaatcgtccggctgatggagcagtactccccgcaggaagcctgcgacagagcgctcaaccagcataccgcaaagctgcttgcccgccgtggcgcctgcggcagcatgtccgtaattgcgcttaaccgcgaaggcgagtggggggcggctactaataaagatgaattttcttttgtcgttgccgaaccagggcgcgccgccgaagtctggctggcgcatcaccatcgtcattcccctgaacgtgcttccgcagagtggctgaacgggtggctggtaaatttgcatgcgggctgcggaggttaagccgaatccctgataattaatgccggatggaatgcttcgccctgcagtggttgtttatcgtcatccatatgacaaagtaacagcctggcggcgttccatcccatctgcgtcgctgaagtgtcgatacaggtaatagacggcgagaaaaattcggtgtcactgacgttttcgaggcaaataatggcgatatcacgattgatatagctgtcttttccgatgccccgtccacgcatttttatcgcggaaatcacttcctgcgtggtggccgcatcatagcaaatcatcgcggtgacccagggagaacgggaaaatagtgccgccattctgtctgctaatgcgccagcgttgctgtccgcaataatcagcgaagtatcttcctcaagattatgttcttttaacgccgcaaagtacccggccagtttctctgcgcgatctagcgatttgggatgtccgccgataaaggcgatatgcatatgcccgacattaatcaaatagcgggtggcgatatttccggcatagtgggcgttaagccctatctgttgaggttgttccgcgacccccgaggaggcgataaacagacagggaatattacgggcattcagacgggcaagggtacgctcattattgtcgcgttcactgacgatcaaaaagccgtcaacgttatagttcagcgcgatattaatgcggttttccagttcggcctgggtttcgaaaatcatgatgaaagagacttttttgtgttcatcaatacagctggtgatccctttcagggcatccacattaaaggcctggcccagaccgtgaaccagtacggcaataagccccgttttaccgcttttaagcgtggcggcattgttatttctgacgtaacccagttcatcaatagccttgttgatccgctccgtcgtccattttgagatacggcctttccccgagagcgccatcgatacggtcgccgcagaaacctctgccagcttcgctacatcggtgatcgtcggttttttccctgccatcctgtgtatttcctctcaaccgcaaggggatctattttacgttattggactgactttctcgccatgatgatccgccgccgtgctttcacttagaaagcataagtaaagaatgtagatccagatcacatttctgcgctatacagtaagctcgtcactgtaatgaggtgctgtatgacatcgctaagtcgtccccgcgttgagttcatctccaccattttgcagactgtgctcagtttaggtctgctcagccttggcctgatcttggtggtctttcttggcaaagagacgctgcatctggcagatgtgctttttgcgccggagcgcaccagcaaatatgagctggtagaagggctggtggtttattttctctacttcgaatttatcgcgctgatcgtgaaatactttcagtccggttatcactttccgctgcgctattttatctatatcggcattaccgccatcgtgcggctgatcatcgtcgatcataaatcgccgatggacgtgctgatctactccgcggcgatcctgctgctggtcctgacgttatggctgtgtaactcgaaacggctcaagcgcgaataaaaaaaggcggcctgcgggccgcctgacaatcaaaagtaacgcaacaatacaagttgaggataacagtggcatatcacgatgaaactcagcctttcaccccgcccgccgtcaggccattcaccagccagcgttgtgccagcaggaacaccacggtgatggggattgcagaaagtacagccgcagcggcaaagtcgccccacaggtagttttgcgggttgagatactgctgcataccgaccgccagcgtgtagctgttaacatcacgcagcaacagcgaggcgaccggaacttcggtaatagcggcgataaacgacagaataaacaccaccgccagaataggcacagagagcggcaacaacaccagacggaacgcctgccatggcgttgcgccatccagcgacgccgcttcttccagcgaaccatcaatggtttcaaaatagcctttaatcgtccacacatgcagcgcgatgccgcccagataggcgaagatcaccccgccgtgggtgttcagcccgataaacggaatgtactgcccgaggcggtcgaagagggcataaagcgccaccagcgacagcacagccgggaacatctggaaaatcagcatacttttcagcagcgtggctttgcccggaaaacgcatacgggcaaaagcgtaggcgcaggtggtggacagcgccacaatgccgatggcggtgatggccgcgattttgatcgagttccacagccataacagcaccgggaacggcggcggcgttacgcgaccatcggcgtgctcaatgctgaagccgagcgccagtttccagtgctcccaggaaatctgatccgggatcaggctgccggtggcgaagttgcccggacgcagcgaaatcgcgatgaccatcagtagcgggaacatgatcgcggcgataaaaattagcagcccgaggtgcgtgagcagaaggcgcagcttttgtgatttgggttgtaccatagccatttacagtgccctccttagtcaaatttcatgcgtgtggctttcaggttgatgatggcaagcgcccccaccagcaggaaaatcagcgtggcgatagccgccgccaggccaaagtcctgcccgccgccgccttcaaaggcgatgcgataggtatagctgaccagcaaatcggtatagcccgcaggcgtggtggtgccgagccggtccggcccgccattggttaacagctggatcagcacgaagttgttaaagttaaaggcaaagctggcgatcatcagcggcgtcagcggcttgatcagcagcgggaaggtgatcttaaagaagttctgcaaagggcttgcaccgtccatcgccgaagcctcataaagatcgtccgggatcgctttcagcaggcccatgcagaggatcatcatgtaggggtagccgagccaggtattgacgatcacgatcatcgcccgcgcggttgtcggatcgctgaaccaggccggacggatgccaaacagcccgctcagcatcatattgatctccccgaagctctggttgaacaggcctttgaagatcaggatcgagatgaacgacggtacggcgtagggcaggatcagcagcacgcgatacagcgctttgcctttgagggattcccactgcaccaggcaggccagtaccatgccgaccgctacggtcagtaccaccgtcaggagtgagaaaatcaccgtccagacgaaaatggcgaagaagggttgctgaatgccttcgtcggtaaagacgcgcataaagttcttccagccgatggtcacggtatagccggggctgagtttttcgtcgccccagttgccgtcagcgttaacggcctggaaataaccgatgtcattgttcgggcgatacaccacgccgctctgattattggtcagcgcgccgtcatcgccgcgcgtatacagcggacgggtgccggagaactggcgcagtgaactcatgatgactttgctgtcgtcgggcagcacagcggtcagctggttcagcgcctgacggttctgggtgatcacgcgcagattgccgcgttcgccttccggcagggcgggggcttctttcagcttcagcgtctgctcgccgccgaacctgaaggcgtctgagacataatttttgccgctttcaccgtcggtcagtgccaggatccagtcattacccgccgggtaaagtccaaaattaaatgactttccggcctgataaacgcgatccatcagcacctcttgcgcccgctcctgggtgagctggttggtgctgctgtagttggtgaaggcgatggcgatggtacagaccagcgggaacaatacgaacagccccatacccgccacgccaggataaacatagcgccaggcataggttttgcggttcgcgaaaatatacaggccagcagagcttaaaatcagcgtcatgatggcaaacaggtactccccctgggcgtacatcaaaaccacaagccaggccaccagcaggccgagcagggcgatggttgcccattttacggtctcgctttgccaccaatgactctttctaacgacatccatggggattcatcctctaccactgtgaaaacctgtaggccggataagacgcgtggcgtcgccatccggcaactgcgactgatggcgctgcgcttatcaggcctacatttattacttacttagttacacgggcctgtgcatctttcagcgcggcgtcaacggtctggcgaccgctggcagcgttgatcactgcggtgcgtacggcataccagaaggccgacatctgcggcacgttcggcatgatttcaccggtctgcgcgtttgccatggtggcggcaatgcgcggatccttcgctaactgatcctgataggatttcagggccaccgcgcctaacggcttgtctttgttcacttccgccaggccatcgtccgtcagcaggtagttttccaggaactctttcgccagttctttgttcgggctggcggcgttaatgcctgcgctcagtacgccaacgaacggcttagaggctttgcctttgaaggtcggcagcatggtcacgccgtagttcactttgctcttgtcgatgtttgcccatgcccacggcccgttgatggtcatcgcggtatcgcctttgttaaaggcggcttcggcgatggagtaatcggtatccgcgttcatgtgtttgtttttgatcagatccaccaggaaggtcagacccgctttcgcgcccgcgctgtcgacgccgacatctttcacgtcatacttgccgttttcatacttgtacgcatacccaccgtcggcggcgatcagcggccaggtgaagtacggctcctgaaggttgaacatcagcgcgctcttacctttcgccttcagctctttatccagcgccgggatctcttcccaggtttttggcgggttagggacgagatctttgttgtaaatcagggagagggcttcaacagaaatcgggtaggcgatgatcttgccgttgtaacgtaccgcatcccaggtgaacgggaagagtttgtcctggaaggctttgtccggggaaatttccgccagcaggccagactgcgcgtagccgccaaagcggtcgtgcgcccagaaaataatgtccgggccatcaccggtggccgccacctgtgggtatttctcttccagtttatccgggtgttcaacggtcactttgatgccagtgtctttctcgaattttttacccacttcggccaggccgttatagcctttatcgccgttgatccagataaccagcttaccttcttcaattttggcgagagccggtgcggtcagcatcatcgtcgcgatcgcggataatgccagaatgcctgcgccagttttgattttcataaatcccgtcctttttggtgatgtgctctcacgatgtcgaacacaggtacacagaggtggcttaacgggtcttagtctcctggtttggcaagcgcttctcatcctcctgcgccctacgccccacccctcctttgtgtgatctgctttgcataaaacccagttatgcggggcagcgcacacaaaaacaccgccatttttgcaatcgccatcacgaatttcgccgatgcacggaacttgtgggggcagagccggtcgcctcatcctcccgtctcctcccccataaaaaagcgaagggtggaggatccacccgcgcaatcaatcccgcatagtccccgcatcttgaaggtttcagcgtagtaacaaagggagaagggcatggcgagcgtgcacttgcgcaaggtaacgaaagcctggggcgacgtagtcgtttcgaaagacatcaacctcgacattaatgaaggcgagtttgtggtgtttgtcgggccgtcgggctgcggtaaatcgacactgctgcgcatgattgccgggctggaaacgatcaccagcggggatttactgattggcgatacccgcatgaatgacatcccgcccgccgagcgcggcgtcggcatggtgttccagtcgtatgcgctctacccgcacctgtcggtggcggagaacatgtcctttggtctgaagctggcgggcgccaaaaaagagatgattaaccagcgggttacccaggtggcggaagtgctgcaactggggcatctgttggatcgtaagccgaaggcgctctccggcggtcagcgtcagcgtgtcgccattggccgtacgctggtggccgagccgcgcgtcttcctgctggatgaaccgctgtccaacctcgacgccgcgctgcgcgtgcagatgcgtatcgagatctcccgcctgcacaagcggctgggacgcacgatgatttacgtgacccacgatcaggtcgaagcgatgacgctggccgacaaaatcgtggtgctggacgccgggcgcgtggcgcaggtcggcaaaccgctggagctgtatcactacccggcagaccgctttgtggcgggctttatcggttcaccgaagatgaacttcctgccggtgaaagtgaccgcaacggcgatcgatcaggtgcaggtggagctgccgaaccgccagcaagtgtggctgccggtggagagcagcgacgtgcaggtcggcgccaatatgtcgctcggcattcgcccggaacacctgctgcccagcgatatcgccgatgtcacgctggaaggcacggtgcaggtcgtcgaacagctgggccacgaaacgcaaattcatattcagatccccgccatccgtcaaaacctggtctaccgccaggctgacgtggtgttggtagaagagggtgccacattcgctatcggcttgccgccggagcgttgccatctgttccgtgaagatggcaccgcttgtcgtcggttgcacaaagagccaggcgtttaagcattcccataacttacacaaaatcattcagggtgcatcgaggcggcaagagaatgaatccccgggagcgtacataagtacgtgactggggtgaatgaacgtagccaacaaagaggcaacctgaatgatgaagtgtaaaaagaaaagcaatgctctcaggagatagaacgatgattactctgcgcaaacttccactggctatcgccgttacagcaggcattctgtctgctcacgctggcgcggtcgacttcaaaggttatgcccgttctggtatcggctggaccggtagcggcggcccgcaacagtgcttccaggcaactggcgcacagtccaaataccgtctcggtaacgaatgtgatacgtacgctgaagttaaactaggccaggaagtgtggaaagagggcgataagagcttctacttcgactccaacattgcctataactcttcacagctgaacgactgggaaaacgacaataccccggcgatccgtgaatttaacgtcgtgggtaaaaacctgatcgactccctgccaggcgcgaacatctgggctggtaagcgtttctatcagcgtcatgatgtgcacatgatcgacttctactactgggatatttccggtccgggcgcaggtctggaaaacattgacgttggtatcggtaaactctccttcgcagcaacccgttctacggaatccggtggttcatccgcagcggctgaacgcgatccggtgaccggtgaaagaacctataacaatgacgtgccgaacgacgtgttcgacgtgcgtttagcaggtctggaaactaacaccgacggcgtactggagctgggcgttgactacggtcacaccaacctgccggacaactacacgctgcgtcagggcggctcgaaagatggctggatgttcaccgctgaacatacccagagcatgatgaaaggctttaacaagtttgtggtgcagtacgccaccgactcaatgacctccaacggcaaaggccgtccggaaggcggcagcatcaataacgatggcagcatgatccgcttgctggatcatggtgcgatcaccctggccgatcgctgggatctgatgtacgtcggtatgtatcaggatatcgaccgtgatgacaacaacggcacccgctggtggaccgtgggcgtgcgcccgatgttcaaatggacgccgatcatgagcaccctgctggaagtgggctacgacaacgtgaaatcacagcgtaccgacgacaccaacaaccagtacaaaatcaccctcgcgcaacaatggcaggctggcgacagcatctggtcccgcccggctatccgcgtattcgctacctatgcgaagtgggatgagaaatggggttacgctaacaccaacgcggataccgctgccggttataccagtggtttagcgtacaacgatacctccgcccgtaccttcagccgtggcgacaacgacgaagtgaccttcggcgcgcagatggaaatctggtggtaatcccccgttaacctgacgtaatgaccaaaagaggggcgtaagcccctcaaccctttgggtgacgcgcgctattgcctggcaaccgtggcacctgtgaattcagaggtgaaaacaatgaaaatgaaaaaaagtctcgtcgcattctgtctgagcgccagcctgctggcggcatgcccgctttccgcgctggcggacgtcaactttgttccgcaaaacaccagcagcgccccggctattccggcggcggagctgcaaaaactgacctggacgccggttaaccagtccaaagcccagaccaccacggtggcgaccggcggacaaaccattaacgtgccggggatcagcggcccggtgatcgcctggagcgtgccggccaatatcggtgaacttacgctgacgctgaccagcgaagtggataaacaaacgcaggtctttgcgccgaacgttttaatcctcgatcagaacatgacgccatccgccttcttcccgagcgactatttcacctatcaggagccgggcgtgatgagcgccgatcggctggaaggcgtgatccgcctgacgcctgcgctgggtcagcaaaaaatctacgtgctggcctttacccgcgatcaggatttgcaaaagaccaccaaactgatcaacccggcgaaagcctatgccaaaggcgcgggtaacgcgatcccggatattcccgatccgctggcgcgccacgtcaccgatggcaagctgacgctgaaagtgaaaaccaacagcggctccagcgtgctggtcggcccgctgtttggctcctccggcccggatccggtgacggtgggcaatactgcggctccggctaccgcctatagcgcaccggcagcacctgttgctgcgccggccccggcacctgttccggcagtgaagaaagagccggtgctgaacgaaaccgaaaactactttaaccagggtattcgtcaggccgtcgccaaaggtgagatcgacaaagccctgaaattgctcaacgaagcagaaagcctgggatcaaaaactgcccgttcaacctttatcagcagtgtaaaaggcaaggggtaattcaccccgcaatgctgattttgctgtttggtgcgccttaacgggcgcacctttttttgcgccccgcgcacgctgttgcgtatctgttacgcttttgcaaaggacatgaactttgcccgcccgtctgtgccggttctgcgatacaatacttttacgttttgtaccggagagtaaggcatgtcacaccctgcgctaacgcaactgcgtgcgctgcgctactttgacgcaatccccgcgctggatccgcaactgctcgactggctgttgctggaagattccatgaccaaacgttttgagcagcagggcaaacaggtgagcgtgacgctgatccgtgaagcctttgtcgcgccggatgagatccctgaggagctgccgctgctgcctgcggaatcacgttactggctgcgcgaaattttactctgcgctgatggcgaaccctggcttgccgggcgcacggtggtgcctgaatccaccctcagcgggccggagctggcgctgcaaaagctgggcaacacgccgctcggacgttatctctttacctcgtctacgcttacccgtgactttattgaaattgggcgtgaggatacgctgtggggacgccgctcccgtctgcgtctgggcgggaagccgttactgctgacggaactgtttttgccggcatcgccgttgtactaagaggaagataaaatggagtggagtctcactcaggataagctgctggcctttcaccgcttgatgcgcaccgataaacccatcggcgcgctgttactgttatggcccacgctgtgggcgttatgggtcgccacgccgggcgtaccgccgctgtggatcctggcggtatttgtcgcgggcgtctggctgatgcgcgcggcgggctgcgtggtgaacgattatgccgaccgtaaaatcgacgggcacgttaagcgcacggcgaaccgtcctatgcccagcggcgcggtaacggaaaaagaggcgcgcacgctgtttgtggtgctggtgctgctggcctttgtgctggtgctgaccctgaacctgatgaccattgcgctctcggtggcggcgctggcgctggcctgggtgtatccgttcatgaagcgctacacccatttaccgcaggtggtattaggtgcggcctttggctggtccatacccatggcgtttgcggcagtaagtgagtccttaccactgagctgctggctgatgtttgtcgccaacgtcttatgggcagtggcctatgacacgctctatgcgatggttgaccgcgatgacgatctgaaaatcggcgtcaaatcgacggccattctgttcgggcgtcacgacaaactgatcgtcggcctgttgcaggtaatagtgctggcgctgatgaccgccgtcggctggctgaacgggctgggctggccttactatgcgtcgatagcagtagctggtgcgctctttatctatcagcagtggctggtggtgaaccgcgaacgcgaggcctgctttaaagcctttatgaacaataactacgtgggtctggcgctgtttttagggctggcggtgagttatctgctgtaaataaaaaaggccgggaggcggtgacgccttacctggcctgtgattctgtgcgtgtttgtaggcccggcaagcaagcgccgccgggcattacgttataccgcgtccgtctgactggttgcgctctcaatcgttaagcgcacatcagaggtcaccagatcggcgagcagctgataaacctgcaaggttttcgccggatccgcatcccccgtatcgctgatatagccctcgtcacgcagcgtcagcaccagcgtactgaacaccgccttatcgaagaactccggcgcgttaataccgtgtagcaccgacagacgctgcgccagcgtgcggctctctttttccagcgtactgcggttgatggacgggttcgcgctcagcagccagaaggtaatggcatagcgttgcagcgtttcacgggcgccggccgccagcagttgcagcgtgcgggagcgtgacggattgatatgcagacgatcgtctttatcaatgatcagcccctggcgcagcagttcggtggtcagggtatccagtacctctcctaacgcctctttttcccagcgcaggaacagctcggctttcagcatcggatacagcgcttcaacatgacgcagcatctcctcgcgggagatatggcgatgctgggtaatgatggccgccatcagggaaggcagaaccagcatatgcgcgatgttgttacggtagtaggtcatcagcaccgcctgctcgcgcggcagaatgatgatgtcgccgatggtatctttctcgacttcaaacttgttcatttgcagcgcgtgatcgataagccctgacgcggtgctggccggcacggtggcgtcttctgaataaggcgcattgcgcagcagatccagataacaatccagctgctcggtcagctgttcgcgggtcagcgaacgctggcgtgacgccagcagcgccgtcgaacacaggttcatggcgttcgccgcaccggcgttgttaatacgcaccatcagctcggcggcgatggtattcaccgtcggcgtcagccacgccgggcgcaccgcttcaataggatcgatcgcttcgcgccactccggcacatgctgattaagatacgcattcagcgggatcggttcgccaaagttcacataaccctggcccagattacgcagcttgcttaagccacgcaccatctgcatcaggttctctttctctttggtcgcgccgcgcagctctttggcgtaagtacccacttccatcacgtgctcgtagccgatgtaaatcggcactaacgtaataggacgggtgccgccgcgtaacatcgcctgaagggtcatcgacagggtgccggtcttcggatcgagcagacgcccggtacgggaacgaccgccttccacaaagtactccaccgaataaccccggctgaacagctcgccgagatactcacggaacaccgtcgaatagagtttgttgcccttaaaggtacgacggataaagaacgcgccaaggcggcggaaaatcggcccggcgggccagaagtttaggttaataccggcggcgatatgcggcggcaccagcccctggtggtaaagcacgtaggagagcagcagataatccatgtggctgcggtggcagggcacatagacgatctcgtgaccgtcgtgggccaactgacgcacgcgctcggcgttgtggacgttgatcccctgatacagccggttccaggtaaagctcagaatgcggtcagagacgcggatcatttcataggagaagttcgccgcaatctcttccatcagggcgacggcattttgctgtgccttttcatgggagatctttttgctgcgcgcttcgtcttccaccgcgcgggcaatggcttttgaggccagcaatttattgaacagatcctgacgcgcaggcaggcgcgggccgaccgcggccagacgctggcgggcaaaatgcatccgcgcgacacgcgccagtttctgggcgataattttgtcagtgccatgttcggtggccatgcggcgcagcgaaaccggcggcgagaagcgcacaaagctgtcgcgtcccagccaggagatagcaaagaatttctgtacgccgttaagcatacgcagcggcgggttgacctcgcctttctcacgacccggcgagcggccaaacatcaccgacaccggcaccatttgcacgtccagatcggggtggttgcggtgcagatcgaggtaatcatggaacagcttgatcgactcttccttcggcgtgtaccaggtgaacacgcggggtccgctgtgaataaagatatagcgcggcagcagcgtgccgtcgatttcgagtggctccagcggatcgggcagatcgtttgccagacactgcgcgcgcagggtcagtaaatctgccttcgagttgtacggtaagacgtacataatagggcgtgaggtatcaagtcccagttcctgggcaggttctgccggaatgggcttgctttttaccaacgcgcctaatggtaaattaagtaatttgtagtaaattcgtggccagccggacatatacgatgtgaagcctctggttaataatcctgttgcgccgcaagaatatcagaaagcgcgcgtaaattctgttgtaccaaggtctgcttgcatagacattgacgctaattacataaaaaggttcttttgatggccaataataccactgggtttactcgcatcataaaagcagcagggtactcctggaaaggcgttcgcgccgcctggatcaacgaagcggcgtttcgtcaggaagcggtagcggtgatcctggcgattgccattgcctgctggctggatgtggacgctatcacgcgcgtgctgctgatcggctcggtagcgctggtaatgatagtggaaattctgaacagcgcgattgaagcggtggtggaccgtatcggcacggattttcatgaactttccgggcgcgcaaaggatatgggctcggcggcggtgctgatgtccatcctgctggcgctcgccacctggggcatgctgttgtggtcgcattatcgataatgctcgcataaatcgacaaactccgctgttttgctcaaaattcgattccaaatttcactttgcctgtatatactcacagcataactgtatatgcaaccagggggcggtatgaaagctttaacggccaggcagcaagaggtgtttgatctcattcgggatcacatcagccagacaggcatgccgccgacgcgtgcggagatcgcgcagcgcttggggttccgttccccgaacgcggctgaggaacacctgaaagcgctggcgcgcaaaggcgtgctggagatcgtttccggcgcgtcccgcggtattcgtttactgcttgaagatgttgacggactgccgctggtcgggcgtgtcgcggcaggtgaaccgctgctggcgcagcagcacattgaaggccattatcaggtcgatcccaatctctttaaaccgaatgcagacttcctgctgcgcgttagcggcatgtcgatgaaagatatcggcattatggacggcgatctgctggcggtgcacaaaacccaggaagcccgcaacggccaggtcgtggtcgcgcgtattgacgatgaagtgaccgttaagcgcctgaagcgtcagggtaataccgtgcaactgctgccggaaaacagcgagttttctcctatcgtggttgacctgcgcgagcagagtttcaccatcgaagggctggccgtcggcgtgatccgcaacggtgagtggctttaatctcttctttccacgcggcggcaacatcatgattgccgccgcgcgtccgtttcccttctggtaattcaacgtggcctttctgacgacttccgacaaagcgttgtggcgtcttgcgctgccgatgattttttccaatatcaccgtgccgctgttggggctggtggataccgcagtcattggtcatctcgacagcccggtgtatctgggcggcgtggcggttggcgccatggccaccagcttcctgtttatgctgctgctttttctgcgcatgagtaccaccggttttaccgcccaggcctttggcgcaaaagatccccatgcccttgcgcgggcgctggtgcaaccactgctgctggcgttgatcgccggtttcgccatcatcctctgtcagaccccgctgattaatctcacactgcacattgtgggcggcaacgacgcggtgctggagcaggcgcggcgttttctggagatccgctggctgagcgccccggcgtcgctggcgaacctggtgctgctcggctggctgctgggtatccagtatgcccgcgcgcctgtggtgctgctggtggtgggcaacgtgctgaatattgccctcgatttatggctggtgatggggctgcacatgaacgtgcagggcgctgcgctcgccaccgtcattgcggaatacgccacttttgtggtcggcctgctgatggtacaacgcgggttgcgtcgccgggggatcagcctggcgatgctgaagaccgcctggcgcggcaatataaggcggctgctggcgcttaaccgcgacatcatgctgcgctcgctgctgcttcagctgtgctttggttccattaccgtgatgggcgcgcgtctgggtggcgacatcgtggcggtgaacgccgtgctgatgacgctgctgacttttaccgcctacgccctggatggttttgcctatgcagttgaggcccattccgggcaggcctatggcgcgcgcgatggcagccagttgctcagcgtctggcaggcggcctgtcggcagtcggggatagtggcgctggcgtttgcgatggtgtacgcgctggccggtgagcagattatttcgctgctgacctccctgccggatctgcaacggcttgccgggcactaccttggctggcaggtgattttaccgatcgtgggggtatggtgttatctgctcgacggcatgtttatcggtgctacccgcgggacggaaatgcgtaacagtatggccatcgccgccgccggttttgccctgacgctgctcagcgtaccgctgctcggtaatcatggtttatggctgtcgttaaccgtcttcctggcgctgcgtgggattacgctggcgtggatctggcgtcagcactggcagcacggcacctggttctcataagttcactggcgctttattgcgttgatggttaaatattccgaataatctccgcttcgacatctccttaactacaataattatcacgttcagcagaaatcgaacgaactgatggatactgaatatatttttattcaaaccgaacgatgaggatatcattatgaataaagacgaagtcggcggtaactggaaacagttcaaaggtaaagcgaaagaacagtggggtaaattaaccgacgatgatatgactgtcatcgaaggtaaacgcgaccagctggttggtaaaattcaggagcgttacggctaccagaaagaccaggctgagaaagaagttggtgactgggaaacccgtcacgattaccgctggtaatcacggacttctgcggcaattagcgttacagctaccctgcccgaaaggtacaaggatgtaccaacctctctctacattcccaccttatttctaacgcggttttttcttcacctgaatgctgtgatcgtgctgacaggcaccctgatgacgacaggcttccacttctgaacatgccgcacataaaccatgcgcttcaatgacattatggcgtagcgcaaaacccattcgcgcggccagaccatgcataatatcttccacaccttccgccgcttcttctttgacggctccgcaacgatcgcagataaacattgccgacgtatgggccggattatcaaaaagatgacacagcacatagctgttggtggactcaactttatgcacaaagccctgctccagcaggaagtccagcgcacgatacaccgtgggcggcttcgcctgtggctcagatacccgtaataaatccagcagatcgtaagcgctgatcgccccttcctgcaggcttaatagccgtaatacttccaggcgctgtggagtcaggcgcacattgcgttgcacgcagagcttttcagcctgcgctaacatctcctgcgaagtggtcttatccatgggcatcctctggtggccgggtgcgaaaacatccactttatcatgttctgccttaaacgccgagatccgcacgcaggtgtgctatatctgaagcattatttatgaaggagaaaggacatgaaaaagcccgactgtattcggcactggcgggatctcgaaggtcccgacgaatcaggctacccggacagcgatgaacgtttttctgttggcgcgcctcttgcccgaaaactcgggcttacgcggctgggtatccatcacgaacgtctacctccgggccgacgcacatcgtatccgcacgcggaaagcgatgaggaggagtttatttatgtgctggaagggaatccggaggcgtggattaacggctatttatggaaactggaaccgggcgacagcgttggatttcctgccggaaccggcgtttgccatacctttatcaataacaccatggaagaagtacgcctgttggtcgtgggggaggcgaataaaagaaataaccgcatttattacccgctcaatcccgactatgccgccacgcgggacgatcgctggatagaccatcctccgcagtttttcggcccccatgatggaaaaccttcacgaaattaatttcgtcttctataaattaataggcccgtcaccggaacgggaaagcagtgaataagaccatcagcgttaaaacatcctttaaattgaattagccgtatttaacatcgttgttcacagcaatagttcatccccgttcgggcgataactgtcggggtaagatgttcaattattcaaagaagagcaaactgtgaaaaaaacattcaaatattcaatggttactctcgctgtctccttttttgtggcaaatcaggcgtcagcggccaatacctgggcagaagcgcgtggcgacgcaatgggtggtacgggtgttgcttccgcgagctatggcagcggcgcactcattaacccggccttgctggccaaagcaaagccggatgacagcgtgactgtgatcctgccagccgtgggcgcgcaaatcaccgacaaagacaatcttcaggatgagattgacgaaattaatgacaaagtcgaccgctacagcgacgttgtcgataaccttaccgcagcgcaaattattgctaacccgctgggcactatcgggcaattccagagcgccgctaaggatctggcggatgagctggaattccttgatggtaaaaccgcgcgcgcaagtgccggcgctggcattgccgttagtattcctaacgacgtgctgtcggtggccttcgtaactaaagcccatgcgcatgcccgcgtcagttcgaacattgatcagcaggatattacttacctgcgcagcatccagaacagcaggctggtggccgtcggtgaagcgcttaatgccgcgctgtcgccaaacggctctgatgaaatcaccgaaaatctgaactccaccgcctccgggcgcgcggctatcgtctcggattacggtatcgctgttgcccgtcagttccaggtgggtgaagttccggtttctatcggcgtaacgccgaaattccagaaaacctgggtctataactacaccacctccatttacgattacgacagcgacgatttcaaaagcagccgttatcgtaccgacgacaatggttttaacgtcgatgccggtattgcggcagatttcggcgaaaactggaccgtaggcgtgagcgggcagaacctgatctcccgcgacatcgacaccaaagatatcaacgtgcgtaacggccgtaccggtgaggtgagaaattacaaagacacctaccagatcagcccggtggtgacagcgggtgtggcatggcataacgatctggtgacggtaaccgccgatggcgatctgacggaaaccaaaggcttcaagagcgaagaaaactcgcagtatgtgggcgtcggcgctgaagtccgtccgttagactggatggcggtgcgtgccggttaccgtgcagacgtgaaagataacgatagcaacgtctttaccggcggtctgggcttcacggcctttgaacgcgcgcgtcttgacctgaccggtatcgtgggcgaaaacgaaacctggggcgcaggcgcacagctgagcctgaccttctgagttaaagcggaccgggggcgcatcgcctccggtctgctaatgtgtaccccggaaatgagtgtgttatagtagcgcccctttttcatattgatgcaaaaatgtacgctatggcacccgtaactccgtccacccaattcgcttcctcccgcttctccatcgcgccgatgctcgactggacggacaggcattgccgctactttttgcgtctgctgtcccgcgatatgctgctctacaccgaaatggtcaccaccggcgccattattcacggcaagggcgattatctggcgtacagcgaggaagagcatccggtcgccttacagctgggcggcagcgatccgcagcagctggcgcagtgcgccagactggcggaagaacggggctacgatgaaatcaacctcaacgttggctgtccgtccgaccgcgtacaaaatggcatgttcggcgcctgtctgatgggcaacgcccaactggtggctgactgcgtaaaagcgatgcgcgacgtagtgtcgatcccggtcacagtaaaaacccgtatcggcattgacgatcaggacagctatgaattcctgtgtgatttcatcagcaccgtctccggtaagggcgaatgcgacacctttattatccacgcccgtaaagcatggctgtcaggtttgagcccgaaagagaaccgcgagatcccgccgctggattacccgcgcgtataccagctgaagcgcgatttcccgcagctgacaatgtcgattaacggcggcatcaaatcactggcggaagcgaaagcgcatctggaacacatggatggcgtgatggtaggccgcgaggcgtaccagaatccggggatcctcaccgccgtggaccgcgagatctttggtcgtgaccgcgcggatgccgatccggttgccgtggtgcgcgccatgtatccgtacattgagcgtgaactgagcaaaggggcctatctggggcacattacccgtcatatgctcgggctgttccagggcattcccggcgcgcgtcagtggcgtcgccatctgagtgaaaatgcgcataaagcaggcgcagatattcgcgtagtggaacaggcgctggcgctggtggcggataagcgttaaaaacttcgccagaatttggtcagattcaccacgcctcgcgttaatccgcggggcgttttcgttttatttcagcaggttaactttggcacggatcttgtaatacctgagacaagaatgaaagaaacgtctttcgggagagagccatgctggaactactttttgtcattggattttttgtcatgctaatggtgaccggaatttccctgctcggcattattgccgcgctggtggccgccaccgcgttaatgtttgttggcgggctgttcgcgctgatgattaaactgctgccctggctgctgctggcggtggcgattgtgtgggtgatacgggcgataaaaacgccaaaaatcccacattatcagcgcaataaccgctggcgttactaaggttatgcgtggttgatcacaacctcgtacttttcagaggtgagttcgctgaaaccgcataggatttacttatcggatctggcactatggcgcggttaacgaattcatcgtgctgtcccctacaaacagccgaactaaaaaaagaatgggcctcctcagggaggccctaattcttttaagggatcagtaaacttgacccctgagtggcgcggctttccagtacctcatgcgcccgttgcgcatccgccagcgcaaacttctgatcttccgccacatccactttgatcacgccgctggcgatcagcgagaacagttcattgctggcttcttccagctcctcgcgattggtgatgtagccttgcagggaagggcgggtggcaaacagcgagcctttctggttgagaatccccagattgacgccggtcaccggcccggaagcattaccgaagctcaccatcagcccgtggcgttgcaggcagtccagcgaggcttcccaggtatctttccccaccgagtcatagaccacgcgcaccttcttgccgccggtgatctcttttacccgctcaacaatgctctcttcacgataattgatcacctgccaggcaccggcctgtaacgcgcgctgcgctttttgcgcgctacccacggtgccgatcagcttaccgcccagcgccttcgaccactggcaggcaatcagccccacgcccccggcggcggcatggaataaaaagggttcgtcgggtttaatttcgtaggttttacgcagcagataaaacaccgtcaggcctttcaggaaggaggcggcagcctgttcgaaggagatggcgttaggcaaaatcgctgctttatcggcaggcacgttatgcactgagctgtaagccccgagcgccgactgggcgtataccacccggtcaccggctttgatatgggttacgcctttacccactttgctgaccacgcccgcggcttccgttcccaggccgctcggcagggaaggcggtggataaagcccgctgcgaatataggtatcaatataattgataccaatggctttgttctcaacctggacttcattttccgccggatcggtgggggtgaactccaccgctttcagtacctcagggccaccatgcttgtgaaattcaattcttgttgccatgcttcctcctgaactctgtggtaatctttcgacccaatcatcatctcggtaactccattcactatggcaggaaataaacccttcaacaaacagcctgaacctcgcgacttcaaggtcgaagggatgaaagtccccccgcactcgattgaagcggaacagtcggtgttgggcggtttaatgctggataacgaacgctgggacgatgtggccgagcgcgtagtggcggaagatttctatacccgcccgcaccgccacatcttcactgagatgcaccgcctgcaggagatgagtaaacccatcgacctgatcacgctcgcggaatcgctggagcaacaggggcaactcgacagcgtgggcggctttgcgtatctggcagagctgtcaaaaaatacgccaagcgcggcgaacattagcgcatatgctgacatcgtgcgtgaacgcgcggtagtgcgtgaaatgatttcggtggcgaatgagattgccaccgccggtttcgatccgcagggccgcagcagcgaagatctgctcgatctggccgaatcccgcgttttccagatcgctgaaaatcgtgccaataaagacgaaggcccgaagagtatcgatcagatccttgagtccaccgtggcgcgtattgagcagcttttccagcagcctcatgacggcgtgacgggtgtggataccggctatcaggatctgaataaaaagaccgcgggcttacagcgttcggatttgattatcgtggcagcgcgtccgtcgatgggtaagaccacttttgcgatgaacctctgcgaaaacgcggccatgttgcaggataaaccggtcttaatcttcagtctcgagatgcccgccgaacagatcatgatgcgtatgctggcgtctctgtcccgcgtcgaccagacccgtattcgtaccggccagcttgatgatgaagactgggcgcgtatctccggcaccatgggcattctgctggaaaagcgcaacatgtatatcgacgactcctctggcctgacgccgacagaagtccgctcccgcgcgcgccgtattttccgcgagcacggcgggctgagtctgatcatgatcgactacctgcaattgatgcgcgttccttctctttctgataaccgtacgctggagatcgccgagatctcccgctcgctgaaagcgctggcgaaagaattacaggtgccggtggtggcgctctcgcagctcaaccgctcgctggaacagcgcgccgataaacgtccggtaaactccgacctgcgtgaatccggctccatcgagcaggatgccgacctgatcatgtttatctaccgtgacgaggtttatcacgaaaacagcgatctgaaaggcatcgcggaaatcatcctcggtaaacagcgtaacggcccgatcggtacggtacgtctgacctttaacggtcagtggtcgcgctttgataactatgcgggtccacaatacgacgacgaataagggatctggtcggttttaaaacgtcagatccggtactcattaatgaaggaataacaatgcaagcggcaactgtagtcattaaccgccgcgctctgcgtcacaacctgcaacgcctgcgcgaactggctcctgccagtcgcctggtggcagtcgtgaaagcgaacgcttacggacacggtcttcttgagaccgcgcgaacgctccccgatgccgacgcctttggcgtcgcccgtctcgaagaagccctgcgcctgcgcgcgggaggcatcacccaaccaattttactgctggaaggcttcttcgccgccgacgacctgccgaccattgccgcagaacatttgcataccgccgtccacaataacgagcagctgacggcgctggaaaacgccgaacttagcgagccggtcaccgtctggatgaagctcgacaccggcatgcaccgcctcggcgtgcgccctgaagacgccagcgccttttatcaacgcctctgcgcctgtaaaaacgtgcgtcagccggtaaatatcgtcagccattttgcccgcgccgatgaaccggaatgcggcgccaccgagcagcaactcgatattttcaataccttttgcgacggcaaacccggacagcgttccatcgcggcctccggcggcatcctgctgtggccgcaggcgcattttgactgggtacgtcctggcattatcctttacggcgtctctccgttggatcataaaccctggggtccggacttcggctttctgccggtcatgtccctgacctcaaacctgatcgccgtgcgtgaacacaaagcgggcgagccggtcggctatggcggcacctggatcagcgagcgcgacacccgcctgggcgtggtggcgatgggctacggcgatggctacccgcgggcagccccgtccggtacgccggtgctggtgaatggccgggaagtaccgatagttggccgggtggcgatggacatgatttgtgtcgatctcgggccggacgcgcaggaaaaagcgggcgatcgcgtgaccctgtggggcgatggtctgccggtcgagcgtatcgccgaattcacaaaagtgagcgcttacgaacttatcacgcgactgacctcgcgggtggcgatgaaatacctcgactgatcgtattttgcaggtcccctgcgtggggcctgctgataaccttccattcacatccctctcgatcttcccgcgcttccggtttattgtggttatccgcaccgtaaacctggagaaccaccccgtgtttcagaaagttgacgcctatgctggcgaccccatcctttcgctgatggaacgttttaaagaagatccccgtagcgacaaagttaatctcagcatcgggctgtattacaacgaagacggtgctattccccagctccaggcgattacggaagcgcgggcgcgcctgaatgcccggccgcacggtgcctcgctttatctgccgatggaaggcttaaacggctatcgccataccatcgcgccgctgctgttcggggcggatcacccggtattaaacgcgcagcgcgtcgccaccatccagacactgggcggctcaggggcgttgaaaatcggtgccgatttcctcaaacgctacttcccggactccggcgtttgggtcagcgatccgacatgggaaaaccacgtcgccatttttgaaggcgcaggttttaacgtcgatacctacccgtggtttgatgccgccactaacggcgtgcgcgcggaagcgttactcgaaaaactgaacacgctgccggcgcaaagcatcgtgctgctgcatccatgctgccacaacccgaccggcgcagacctgactaacgctcaatgggatgcagtcgttgaagtgctgaaagcgcgcaacctgatcccgttcctcgacatcgcctatcagggctttggcgcgggtatggaagaggatgcctacgccatccgcgccattgccagcgcagggctaccggcgctggtcagcaactccttctcgaagattttctcactgtacggcgagcgtgtcggcggtctgtcggtggtctgtgaagatgccgacgctgccgcccgcgtgctgggtcagctgaaagccaccgtacgtcgtaactactccagcccgccagcctttggcgcgcagctggtggcgacggtgctgggcgacgacgccctgaaagccagctggctggcggaagtggaagccatgcgcctgcgcatcctggcgatgcgtcaggcgctggttgatgtcctgaaggatgcggtgccggatcagaactttgattatctgctcaaacagcgcgggatgttcagctataccgggctgagcagcgcccaggtggatcgcctgcgcgatgagtttggcgtttaccttatcgccagcggacgcatgtgcgtcgccgggctgaatgctggcaacgtacagcgtgtggcacaggcctttgccgctgtaatgtaagtacttgcttactgctctctctcccggtgtcatgcggccgggcgggagagcagaatgcgatccgtcttctgtttcccgcctcttttttaagaatattcttcctttcacctgcccgtgacgttaaggtcgggtaaatttttgatcgtccgcgcaggttgcaatgattgcgggctgataatgcagggaaaaatatgcgcaaaatcacacttatcctcagcgcctttagtttgctgttcacgcttaatggccccgttaccgctcacgcctcgtcgccttcgccccttaatcccggtactaatgtcgcacaactggcgcaacaggcaccggtgcactgggtatccgtggcgcaaatcgaaaacagtctgctgggacgtccgccgatggccgtgggttttgatattgatgacaccgtgcttttttccagccccggcttctggcgcggcaagaaaacctggtcgccggacagcgaagactatctgaaaaatccggcgttctgggaaaagatgaacaacggctgggatgaattcagcattccgaaagaggtggcccgcgcgttgatcgccatgcatgtgaagcgcggggactctattttcttcatcaccggccgcagcgaaaccaaaacggaaaccgtcaccaaaaccctgcaggatgacttccttattccggccgccagcatgaatccggtgatttttgcgggagacaagccaggtcagaacaccaaaacacagtggttacggggtaagcaaatcaaagtgttctacggcgactccgataacgatattcgcgccgcgcaggaaactggcgcgcgcggtatccgcgtactgcgtgcctccaactccacttacaaaccgctgccgcaggcgggcatgttcggtgaagaagtgatcgtcaattccgaatactgatccccaacggcagtcgcaggattgccgtttttttaatctctgctggcggaaacctggctgaaaacgcactcatgctgcacacttagaaagatttattttcgacagggagctgcaccagaggtgccaacaacaggggaaccccaatgaccaatgcagaattactgccctattgcatgggcaaggcgggagcggaacagagcgtacacagcgactggaaagcgacgcagattaaagtggcggatgtgctgtttgcaatggtgcacgaaacggatggccgtccggcggtcacgctgaaaaccagcccggagctggcggaattattgcgtaatgaacacagcgatgtgcgccccagcgcgcgtctgaacaaagcgcactggagcacggtatttctcgatggatcgctgccggattcgcagatttactatctggtagacgcctcgtatcagctggtggtcagtgcgctgcccgacgccgtcaggcagcaactttccgtctgattacttcagcatcggtttgaggaagcgcgccgtgtgcgaggcttcgcacccggcaacggtttccggcgtgccggagacgaggatttccccgccgccgctgccgccttccggccccagatcgacgatccagtctgcggttttgatcacgtccaggttatgctcaatcaccacgatggtattaccctgatcgcgtaactggtgcagcacttccagcagttgctgaatgtccgcgaagtgcaggccggtcgtcggttcatcaaggatatacaacgtctgaccggtaccgcgtttcgacagctcacgcgccagcttcacgcgctgtgcttcaccgccggacagcgtggtggcggattgtccaagacgaatataggtcaggccaacgtccatcagcgtttgcagtttacgcgccagtgatggtacggcatcaaagaactcgcgcgcttcttcgatggtcatatccagcacttcatggatcgtcttgcctttgtatttgatctccagcgtttcacggttatagcgcttgcctttgcactggtcgcacggcacataaatgtccggcaggaagtgcatttcgactttgatcacgccatcgccctgacaggcttcgcaacgcccgccgcgcacgttaaagctgaaacggcccggcgtatagccgcgtgaacgcgactccggaacaccggcaaacagctcgcgcacgggcgtaaacacgccggtgtaggtcgccgggttagagcgcggcgtacggccaatcgggctctggtcgatatcgataactttatcgaaatgttccagaccctgaacgtcacgatagggcgcaggctcggcgatggttgcgccgttgagctggcgctgggcgatcgggaacagcgtatcgttgatcagcgtcgatttacccgagccggacacgccggtgatgcaggtaaacaggcctaccggcagcgtcagggtgacatccttcaggttgttgccgcgcgcgccggtcagcttaagcactttttccggatccgcaggcacacgcgctttcgggatctcaatcttacgtacgccgctcataaactgcccggtcagcgattccggcaccgccatgatgtcttcaagcgtaccttcagccactacctgaccgccatgaacgcctgcgcccgggccgatatcgataacgtgatctgcggcgcggatcgcatcttcatcatgctccaccacaatcaccgtgttgccgaggttacgcagatggatcagcgtgccgagcagacgttcgttatcgcgctgatgcagaccgatagacggctcatccagcacgtacatcacgcccaccacaccagcaccgatctggctcgccagacggatacgctgcgcttcgccgccggacagggtctctgccgaacgggacagcgtcaggtagttcagcccaacgttcacgaggaatttcagacgatcgccaatctctttcagcactttttcagcgatttttgcacgctggccggaaagtttcagattggtgaagaaatccatcgcatggccgatgctcatgtcggaaatggtcggcagcggcgtgtcttccacaaacacgtggcgcgcttcacgacgcagacgcgttccgtcacaggtggtgcacgagcggttgctgatgaacttcgccagctcttcacgtaccgcgctggattccgtctctttataacggcgctccatattgtgcagcacgccttcaaacggatggcgtcgcacggaagtatcgccgcgatcgttcatgtacttaaattcgacgttctctttgccggatccgaacagcaccactttatgtacgttagcgctcaggctggcccacggcgcttccacgtcgaacttgtagtgttcggcaagggagcgcagcatctggaaataatagaagtttcggcgatcccagccgcggatcgcgccgcccgccagcgacagctccggattctggatcacccgatccggatcgaaatactgttgtacgcccagcccgtcgcaggtcggacaggcgcccgccgggttgttgaacgagaacatacgcggttccagctcattcatgctgtagccgcaaatcgggcaggcgaagtttgcggagaacagcagttcgcccgctttggcgtcgtccatatcggccacgatcgccgttccgccggagagatccagcgcggtttcaaaggattccgcaaggcgctgcgtcagatcgtcgcgcactttaaagcggtcgatgaccacctcaatggtgtgtttcttttgcagctcaagcgtcggcggatcggaaagatcgcagacttcgccgtcgatacgggcgcggatataaccctggctggccaggttttccagcgttttggtgtgctcgcccttacgatctttgatgataggcgccagcagcatcagccgcttgccttcaggctgcgagagcacgttatcgaccatctgactgaccgtttgcgcggccagcggaacgttatgatccgggcagcgcgcttcgcccacgcgggcaaacagcagacgcagatagtcatgaatttcggtaatggtcccgaccgtggaacgtgggttgtgcgacgtcgacttctgctcaatggagattgccggcgacagcccttcaatatgatcgacatctggcttttccatgagggacaggaactgccgcgcataggcagagagcgattcgacgtaacgacgctgcccttcggcataaagggtgtcaaaagccagcgaggatttgcctgaacccgaaagcccggtcacgacaatcagcttgtcgcgtgggatgacgatgttgatgttcttgagattatgggtacgcgcgccccgtacttctatcttatccattcacctttcccggtagagattcggctgccatagcgttatgcatccatttcggtaagcatagaacacgcccggcggtctgaactgaaacgattaattatgacacaatttaacctgaatggatatacagtgttatgatgcgccttccagtgagtcttgcaacaatgtcgcgacggcgcggtttactggaatccgcctcgcaaggtatcaatcgcgcggtttgtaatgctacaatcgcgcgtttacactattaagaaacgtattcaggagacacgaccatggccagcagaggcgtaaacaaggtgattctcgtcggtaatctgggccaggacccggaagtacgctacatgccgagtggtggcgcagtcgccaacattacgctggcgacctccgaatcctggcgtgataaaaacaccggtgagactaaagagcagactgaatggcaccgcgttgtgctgtttggcaaactggcggaaatcgccggtgaatatctgcgtaaaggctcccaggtgtatatcgaaggttccctgcgtacccgtaagtggaccgatcagagcggtcaggaacgctacaccactgaaatcaacgttccgcagattggcggcgtaatgcagatgctgggtggacgtcagggtggcggcgcaccggcaggcggcggccagcagcagggcggctggggtcagcctcagcaaccgcagggcggcggcaatcagttcagcggcggcgcgcagtctcgcccgcagcaaccgtcttcagcaccggcgcagtctaacgaaccgccgatggattttgacgacgacatcccgttctgatcctgaccatcagtacgcaaaaagccccgcattgacggggcttttgttttggtgcgacgccatcaggtgatgaccaccggccattcaggtggcgtgtgactggaggcttcaatcattacgtctttaatattattccagatcgccgccacatcaatcagcgtaatgccgagcaaaccggtggcgaaccagcaggcggcgatcacgcccagcccgctgctgatcaccgcaagaccgatataatcagacttgcgaaagcgaatgtttaatgtgctggcaagaaacatcagcaccgcgctcaataactgccagcgtagcaataccacgccggtggtaatggtagccatcaacccttcctctgataaccaatgaaacgtgatttcattttcacaatttttgtgaactatatcacatttgctcttttattcgccagtgatctgcgtcaattttgctcagtttcatatccataaagggggcgtcagccgctttgttagcgcctttcaggccacggctatatgcctcttttagaaacagaagggtaacaacattatttttttattatgcgtattctttgcacaccattcacttttgcagtttaaaaaataaacatctgccggttatcatttttatcggcctgcaatttgcgttaatcagcgatcccctgttgagttatcttaaaccttgacgacgaactggatatttattttccttaatataaacagggggaacacttttagtttgccttacggacgaatattatcgtcataagcagatattaggtttcttatgaaaaaagtcagttgctaatgtcttatgattcatgcaacgtaatcacctgttaatcaaagcatcctgtcgttattacaggcacacattttgcagggatattaggcggaaatgaatcatagcgcacttcgcaaggtgctgaggatcgtcgggatcatcatggtagttatactgcctgtgatgctggcgctatggtttgcacacatccgcgcggtaaaagaaaccagcgcgcagctcaatgcatttgcgcaactcgcgctggataaaaccgagctggtgatccgtcaggcagatattgcctatgacgaagccctgaaattcagcggcccgctctgttcgccgttgcatcggcaaaatatgcttaatattattcgcgggcggctttatctggcggatctcatctatacccagggcgatcattttttatgctccaccagtattactttgcctcaaccttatattattcctgctgctgattataaacgtaatcctgacgtttcaatttattactatcgcgatacgccattttattccggatataagatggtgtatatgcggcgcggtaattatgcggtagtggtaaatccacttttttacagtgaagtggcatcagacgatcgtacattaacgtatggcgtttatgacaatatcagtaaaaccttcttttcagtcagtcctggcgctaacgttaaaatattgtctgaacatgtacaaaatgagaaattaaacttccggacagataatcgtttctataccattgcccattccgacaagcgacctgtttcgatgatcgtctcgacgtccagcacccgctattatggtttcctgtatcatcaggccatgctgttggtcccgctggcgctgatcggcagtattctccttctactgatagtctcacgtacccggcatgaatttaactccccgcggcgtttgctgcatcgggcgctgctaaagcgtcaactcaggctgcattatcaacccattatcgatatcaaaaccggtaaatgcgtgggcgcagaagccctgctgcgctggcctgggtttaatggtccggtgatgagcccggtggagtttataccgctggctgaaaaagaagggttgattgaacgcgtcaccgattatgtggttgaagaggtgtttaccgatctggggcatttcctcgccgccaacccgcacctctatatttcaattaacttatccgcctcggatttccattcgtcacgcctgattgcccttatttctgataaggcaacacattacgcggtgcgggctgaacaaattaagatcgaagtgaccgagcgcggctttattgatgtgccgaaaaccacgccggttattcaggcgttccgtcatgcgggttatgaagtggcaattgatgatttcggtaccggctattccaacctgcataatttatattccctcaatgtcgatattctgaaaatcgacaaatcttttatcgatactctgacgactaacagcaccagccatttgatcgctgaacatattattgagatggcgcacagcctgcgtctgaagatcattgcggaaggcgtggaaacggcggagcaggtcacctggctgctaaagcgcggcgtgcagttctgccagggctggcactttgcgaaggcattatcgccgcaggattttattcactgggcgcagcagcacgactaagcgcttgtcccggtagtctcaacagacgcctgacgggataagcgctcataggggtttacatctgatgacggtaatcgctgggcgttctgtcgaattcgcggcgaaatacacgcgaaaaggtttgctgcgatacatagcccaggtccatggcgatatcaaaaatgggccgccgcgtggtgcgcagcgcttctgccgccagcagtaaccggcgctgtcggatgtaatcccccaacgtctgatgcatcaccgcgcggaacattctctgtaaataccatttcgaataaccggactttctggcgaccacatcaatgttcataggttggtcgatatgttcatcaatccattcaatcagtgtctgaataatttgctgatgggacatactagcctctttgtcagttctgccgctgtcgttttgtctgcgggcgagtataattcctcaagttaacttgaggtaaagcgatttatggaaaagaaattaccgcgtattaaagcgctgctcacccccggcgaagtggcgaaacgtagcggcgtggcggtatcggcattgcacttttatgaagccaaaggtctgattaaaagtgtgcgtaacagcggtaatcagcggcgttatacccgtgatgtgctgcgttatgtggcgatcatcaaaatcgcgcagcgtatcggcattccccttgcaaccattggcgaggcgtttggtgtgttgccggaagggcacacgctcagccctaaagagtggaaagagctatcttcccagtggcgtgtggaactggatcggcgtatccatacgctggaagcattacgcgatgagctggacggctgtatcggctgcggctgtttgtcacgcagcgactgcccgctgcgtaatcccggcgaccggctgggcgagcagggcaccggcgcgcgactgctggaagatgattaatattcgccacaaaaaactaaagcgccgttacggcgctttagtttgtttcccggtcttttgtctttcgctctatcccacgggtttgtgggagggtctcccccgacatcaatacccctcggtgtaactaaaaacgctggagggtccggtttgtatcgacacttttagtgtaagtcagcagggcagctttgccagcggcaaccggggaattatcaccgaaatttttcgcgcatgatgcacaattttctatagtaagtacttacctggttaacggagtaaatcatgcttaaagtgcatcatcttaataagtcccgttcacagcgtgtgctgtgggcgctggaagagcttggcgtgccctatgagatcgtgcgttatcagcgcgaaaaaaccatgatggcccctgaagcgctgaaaaaagtgcacccgctgggaaaatcgccggtgctggaagatgacgggcgcattattgcagagtccggggccatcctcgaatacctccaggaaaactatgatccgcagggcaccctgaaacccaccgatgccgaccagcgcctgcagtaccgtttctggctgcattatgccgaaggctcgctgatgccgccgttactgatgaagctggtattcagcagcctgggcaagccgccggtgccgctgggttttcgcaccctcggtaaagcgctggggcagggggtgcaaaaaggctatctcaataaacagatcgaaacgcacgcccgctatatagaagcggagctcggcagccagccctggtttaccggggagtcccccagcatggcggatattcagatgagcttcccggtgtttgccctgctggctcgcggcggcgttgatcacctgcccaatttgcaggcatggaagaaacgcgtcgagatgcgtccggcctggctgcgtgctattgaaaagggcggtccgttcgagttgcctggggaataaaatcacgttagaaggcgataaaattgttacagggttgcgcatttacgacaacgtttgcgcatcccctgctgctttcttcgtcgtcctgagcgaaatttcataaaaagcgacaaagttaagttgaaatacccctgtggatggctggataatcgtttgcctttttcaacagccgttttgtttgcgcggagttaaacgtttgctttttgtggcactgctttgccgcaacgtagcacatggagatgacgtttaatctggcagtggattgtccgccacgcaaaccagcgaatataaaaattctcaggggatgttttctatgtctacgccttcagcgcgtaccggcggttcgcttgacgctttatttaaaatttctgcacgtggcagcactgtccgtcaggagatcgtagccggtcttaccaccttcctggccatggtttactccgtgatcgtggtgccaggcatgctgggcaaagcgggcttcccgccggcggcggtgtttgtcgccacctgtctggttgccggtctgggctctattgtgatgggactgtgggctaatctgccgctggcgattggctgcgccatctcgctgaccgcttttaccgctttcagcctggtgctcggccagcaaatcagcgtacctgtcgctctgggcgcggtcttcctgatgggcgtgctgttcaccgtgatttccgccaccggcatccgtagctggatcctgcgcaatctgccgcagggcgtggcgcatggcaccggcatcggtatcggcctgttcctgctgctcattgccgcgaacggcgtgggtctggtggtgaaaaaccccatcgacgggttgccggtagcgctgggccatttcgccagcttcccggtgatcatgtcgctgattggcctcgctgtgattatcggtctggaaaaactgaaagtgccgggcggcattctgctgaccattatcggcgtgtctgttgtcgggctgatttttgatccggcggtgcacttctccggcatttttgccatgccgtccctgagcgacgaacacggcaattcgctgatcggcagcctggacattatgggcgcgctgaacccgatcgtgctgccgagcgtactggcgctggtgatgaccgccgtgtttgatgcgacaggcaccattcgtgcggtggccggtcaggctaacctgctggataaaaacggtcagattatcgatggcggcaaagcgctgaccaccgactccctgagcagcgtcttctcaggcctggtgggcgcagcaccggcggcggtgtatatcgaatcggcggcgggtacggcagcaggcggtaaaaccggtctgacggcgatcaccgttggcgtgctgttcctgctgatcctgttcctctctccgctctcctatctggttccggcttacgccaccgcccctgcgctgatgtacgtgggcctgttgatgctgagcaacgtgtcgaaaatcgattttgccgatttcgtggatgcgatggcgggccttatcaccgccgtattcatcgtgctgacctgcaacatcgttaccggcatcatgatcggcttcgcctcgctggttattggccgtgtagtctcgggtgaatggcgtcgtctgaacatcggtaccgtggtgatcgcggtggcgctggtggccttctacgcgggcggctgggcgatttaattttccgatccggctcgaaaaaaagggtggcgcttgccgccctttttactttttaaggcacatcctgtttccattgcgttaagctgcatgttctattatgaaaggcatgatgcctcgtcatcgattataaagaatcatcgcaaacagggaacgcatggaaattttcttcaccatactcatcatgacccttgtggtctcactctcgggtgtcgtcacccgtgtcctgcccttccagatccccctgccgctgatgcagattgccatcggcgctatgctggccttacccacttttggtctgcatgtggagttcgatccggaactctttctggtgctgtttatcccgccgctgctgttcgcggatggctggaaaaccccaacgcgcgagtttctggagcacgggcgtgaaatatttggccttgcgctggcgctggtgctggtcaccgtggtcggcatcggctatctgatttactgggtggtgcccggtattccgctgatcccggcgttcgcgctggcagcggtgctgtcgccgaccgatgccgtggcgttgtccggcattgttggcgaagggcgcatcccgaaaaaaattatgggcatcctgcagggcgaggcgctgatgaacgacgcctcaggcctggtggccctgaagtttgccgtcgcggtggcgatgggcaccatggtcttcactgtcggcggcgcgaccgtggaattcctcaaggtggcgattggcggtctgctcgccggcttcgtggtcagctggctgtatggccgctcgctgcgttttctcagccgctggggcggggatgaaccagccacgcaaatcgtgctgctgttcctgctgccgttcgcctcttatctgatcgcagaacacatcggtgtgtccggcattctggcagcggtggcggccgggatgactatcacccgttccggcgtgatgcgctccgcgcctctggccatgcgtctgcgcgccaacagcacctggtcgatgctggaattcgtctttaacggcatggtgttcctgctgctgggtctgcaactgccgggcattctggaaacctcgctggtggcggcggaagccgatcctaacgtcgaaacctggatgctgtttaccgacatcattctgatttatgccgcgctgatgctggtgcgtttcggctggctgtggacgatgcagaaattcagccagcgcttcctcaccaaaagcccgatggaatttgggatgtggagcacgcgcgaactgctgatctccacttttgcgggcgtgcgcggggcgatcaccctcgccggtgtactctctattccgctgctgttaccgggcggggaacacttcccggcgcgttatgaactggtcttcctggctgccggggtgatcctcttctcgctgtttgtcgccgtggtggttttacctatgctgctgcaacatatggagatcgccgaccacgctcaacaggcgaaagaagagcggctggcgcgggcgaaaaccgctgacgtggccattgtcgccattcagaaaatggaagagcgcctggcggccaacgccgaggagaacattgacgatcagctgctgacagaagtcagttcgcgggtgatcggtaatctgcgtcgccgcgctgacgggcgtaataacgtcgaaagctccatgcaggaagaaaatctcgaacgccgcttccgccttgcggcgctgcgttccgagcgggcagagctgtatcatctgcgcgccacgcggcagatcagcaacgaaacgctgcaaaaactgctgcacgatctggacctgctggaagcgctgctgattgagaataagtaggatatgtccccctcaacctgtgggtgagggggctaaagcactactttgtcaggcgtgacaccagttcaaactctttaaaattcaccgggcgttgttgctgcatggagatattcccggcgataccggtaaggatcgacatcgcaccggcgcggtgatcggcggcacgctgcagcggatcgtgcgtggcggggccgaataaatccgccagcatggcgttatctccgccgccgtgtccgccttcaccgatggcgaattcagctttccagggcgcggcaaacatcgggaacaccgtgatgtcgcagccttccaggctcccttcgctggcgcgatcgccaccggcgttgacgtaagatttctccacaagcttcatctccagacggccttcactgccgttaaacaccacgttcagcccctcccatggcagataggcgttcagggaataggttagctgcacctgattctggtatttcaccagcaccgacatggtgtcttcaatggtgatgccgtcgctgaacacgctctgatcgcgaaaatagttatcttcgtgctcggcatccagatacagcgctttcagctggggattgtcctccatgtgcagggcaaagggatcctctttagcggcggcgtagccgtgggcgcggggataaaactgcgtgataccgcgtcgctcggcgttctctttaccataaaagcgcaggctgccttcggcatagacgcgctgcggatagctccccagccagaagttcatcaggtcgaaatggtgggtggatttgtgtaccagcaggccgccgctgttgcgcttttcccggtgccagcgacgaaaataatccgcgccgtgttcggtgttcagcagccattcaaagtgtaccgagttcacctcgccaatggtgccgttcatcagcagctcgcgcactttgctgtgatgcggcgcatagcggtagttaaaggtcacacgcacctgacggcccgtctcttcaatggcatcgaggatgcgcagcgcccgctgctcgtcgatggtcatcggtttttcggtgatcacatcacacccggcgtacagggcgcgcacaatataatcatcatgggtacgatcgacggtggtgacgataatcacgtccgggcgcgtctcgcggatcatctcctcaaactgcgaggcgtgccaggtggacgctggcgcagccccttcgtttttcagcaactgattggcgtagtgcatacgcgtgtggttggtatcgcagaaggcgaccagggtggccgtctctttccactgaccgccgatggccgcaatgtacatcccggcacgcccgcccgtgccgacaagggcatattttttcataccatcctcgattaattacttaatgaaattattggcttaacgcgtaagccagggcttccatcagcataaaaagcgggaagggcattgtcgtgacggcgcagagtgcaaaataaggtcaggaagatggagtggcgcaaactgtgacggggcttacaaaacgcgccgggaggctgtgacgcggatcgacttttgtcgcacgcaggacgtgatgttgctcacgatgaaacacaaccccggcccgcaggccgggggtaaaacagattaatgcgcgcggccctgatcgatgccgataccggtttgcgaacggataaactgggcgcggaacttctcgcgttccagtttcccttccgcggtattgtcggttgccgagaatacccagataccaataaaggccaccgcaatggagaacagcgccgggtactcatacgggaagatggcgctggcgtggccgaggatctgcacccagattgtcgggccaagcaccatcagcaccacggcggtaatcagccccagccagccgccgatcatcgcgccacgggtggtcagcttcgaccagtacatcgacagcagaatgatcgggaagttacagcttgccgcaatcgagaacgccagacccaccatgaaggcaatgttctgattctcaaacagaatacccagcaggatggcgatcacgcccagtaccagcacggtgatttttgacacccgcagctcgtcgcgctcggtggcccctttacggaacacgttggcgtacagatcgtgcgataccgccgatgcgcccgccagggttaagcccgccaccaccgcgaggatagtcgcgaaggccaccgccgagataaagccgaggaacaggttgccgcccaccgcgttggcaagatgcaccgccgccatgttattgccgccaatcagcgcgccggtggcatctttaaacgccggattcgcgcccaccagcatgatcgcgccgaagccgataataaaggtcaggatgtagaagtaacccataaagccggtggcgtagaacacgcttttccgcgcttcacgggcatcgctgacggtaaagaagcgcatcagaatatgcggcagccccgcggtaccaaacatcagccccagccccagcgacaacgcagagatcggatcttttaccagcccgcccggactcatgatcgccgtgcctttcgggtgcaccgccatggcttcggtaaacaggttattgaagctgaaaccgacgtgacgcatcaccataaaggccataaagctggcgccgaacagcagcagcacggctttgatgatctgcacccaggtggtggccagcatgccgccgaacagcacgtacatcaccatcagcacgcccaccagcaccacggcgatgtgatagttcaggccaaacagcagctggatcagtttgcccgcgcccaccatctgcgcgatcagatagagcgccaccaccaccagcgagccgcaggcggagagaatacggatcggaccctgtttcagacgatacgacgccacatcggcaaaggtgtagcgtccgagattacgcagacgctcggcgatcaaaaacagaatgatcggccagcccaccaggaaacccagcgagtaaatcaggccatcgtagccggaggtgaacaccagcgcggaaatccccagaaaggacgccgccgacatgtaatccccggcgatcgccaggccgttttgcagaccggtaatattaccgcccgccgtgtagtaatcgctgcgggtgcgggtacgttttgacgcccagtacgtgatgccaagcgtaaaggcgacgaacaccacgaacatgatgatcgcctgccagttggtcggctggcgctgcaccgcgccggtcagggcatctgccgcgttcgcggagaaagggagtatggcggcagccgccgtcagtaatctcttcatggtgcgtttacctcgcggatcacggcattgttcagacggtcaaactcaccgttcgcccgccagacgtaaacgccggttaacacgaacgaaaccaggatcacgccgacgccaacaggaatgccgcgcgtgacgctggtgccgggatagagcggcgtacccagccagccaggcgcgaaggcgataagcagaataaagcagacataaatcgccagcacgatcagcgacaaaatgatggcaaaccgttgccttttttcgaccagctccctgaaatgcgcgttatgttctatccgttgataaatgagttcattcatcacgaaatctccagaggctccctgtgtctttcgcgccgcaggtgcgttggccgcgctcgcccacacccagtcacatagttaactatgctcctggggatgtgctcgcttgccgccttcctgcaacgcgaaatccttcgggatggtttttatattttccctcccggtcaaaggaggggtaggggtaggatttattggcccgataagcagcgcgccaccgggcatttatggttatgacggcatcgtaatgccttgtttttcttccagcagtttttccactacgccaggatcggcaagcgttgaagtatctcccaggttactggtgtcaccggcggcgattttgcgcagaatgcggcgcatgattttgccggaacgggttttgggcagcgaatcggtccagtgcagaatatccggcgtcgccagcgggccgatctctttccgcacccagttgcgcacctcggtatacagttccggcgacggctcttcgccgtggttcagcgtgacataagcgtaaatcgcctggcctttaatattgtgcggaatacccaccaccgccgcttcggcgattttcgggtgcgagaccagcgccgactcgatttccgccgtccccagacggtggccggagacgttcagtacatcgtccacgcgcccggtgatccagtagtaaccgtcttcgtcacggcgcgcgccgtcgccgctgaaatacatattcttgaaggtggagaagtaggtttgttcgaagcgctcatgatcgccaaacagcgtgcgcgcctggcctggccatgaatcgacaatcgccaggttgccttcggtggcgccttccagcggattgccttcgttatccaccagcgccggttgtacgccgaagaacggcaggctggcggaaccggctttcagctcgatggcgcccggcaacggcgtgatcatgaagccgccggtttccgtctgccaccaggtgtccatcaccgggcacttttcgttgccgatttttttccagtaccactcccaggcttccgggttaatgggttcgcccaccgatcccagaatccgcagcgaggcgcggctggtgccgtcaatcgccttatcgccttccgccatcagggcgcggatcgctgttggcgcggtatagagaatattgacctgatgcttgtccaccacctgcgccatacgcgctggcgtcggccagttcggcacgccttcaaacatcagggtagtcgcgccgcaggccagcgggccatacagcagatagctgtggccagtcacccagcccacgtcggcggtacaccagtagatgtcgccgggatggtaatcgaagacgtatttgaaggtggtcgcggcatacaccagataaccgccagtggtgtgcagcacgcctttcggtttaccggtggagccggaggtataaaggataaacagcggatcttcggcgttcatcgcttccggctggtggtcgctgctggcggtcgccatcacatcgtgccaccacagatcgcggccttcctgccagtcgatagcgccgccggtgcgtttaaacaccacgacgttttcaatcgtcgtcaccgccgggttttttaacgcgtcgtcgacgttcttcttcagcggaatactgcgcccggcacgtacgccttcgtcggcagtgatcaccagccgtgagctggagtccacaatacgcccggcgaccgcttccggcgagaaaccgccaaaaataaccgaatgcaccgcgccaatacgcgcgcaggccagcatcgccaccgccgcttccggcaccatcggcatatagatagctaccacgtcgcctttcttaatgcccagcgtcagcaggacattggcaaagcggcacacttcgccgtgcagatcgcggtaagagatatgtttgctctggctggcgtcgtcgccttcccagatgattgccgtttgatcgccacgctcagccagatgcctgtccaggcagttagccgccaggttgagctgtccatcttcataccatttaattgaaacattccccggcgcaaaggaggtgtttttcaccttctgataaggcgtgatccagtcgagaattttgccttcctcaccccagaaagcgtcaggatcggtgatagattgctggtatttcgcctggtactgttcggcattaatcaggcatttttccgcgatctgggcgggaatagggtgtttgtggatttggctcatggcttttgttctccttgtaggatgttaataatatgtcacacaaacgttaattgtaggggctttgggagctttgtttactttttgggcgacagatcacgcaatgcttgagtgtatgaaaatgcagcagatgatgcttagaagggaaataatttacgctaagaactattgcttttatggcaattaaaaattcatctataacaaatagttatgcatgataaatgctataaaatgcgctttttaagtgagaaatcagcgaaagtccctgaacttaaagggttgcacgggataccacgcaaatggtactgataatgcgcgttaaaaacccccgcttttgtaagaaacgctaaccatcccccttgctggcagtcttcatgcacagcagggaatagcgcttcactaaggatgtcactcgttatgaaaaatgtgaaagtcagcctggcctggcaaattttgctggctctggtgctgggtattcttctgggtagttacctgcattaccaaagcgacagccgcgaatggctgattgcgaatctcctgtctccggcaggcgatatctttattcatctgatcaaaatgatcgttgtccctattgtgatttccaccctgattgtgggaattgctggcgtgggcgatgcgaaacagctgggccgcattggcgcgaaaaccattctttatttcgaagtgatcactacagtggccattattcttggcatcacactggcgaatgtattccagccgggcgcgggcattgatatgtcgcagctggcaacggtggatatttcgaaataccagagtacaacggcggaagtgcagagccatgcccatggcctgatgggcaccatactgtcgctggtgccaaccaatatcgtgtcgtcgatggcgaagggcgatatgctgccgatcatcttcttctcggtgctgtttggccttgggctgtcatcgctgccttccgcacaccgtgagccgctggtgacggtcttccgctccatttccgaaaccatgtttaaagtcacccatatggtgatgcgttatgcgccggtgggcgtgttcgcgctgatctcggtgacggtggcgaactttggtttcgcctccctgtggccgctcgccaagctggtgatcctggtgtatgccgcgattgtcttctttgcgctggtggtgctgggcgcggtggcgcgtctgtgcaagctgagcatctggacgctgatccgcatcctgaaagaggaattgatcctcgcctattccaccgccagctccgaaagcgtgctaccgcgtatcattgagaagatggaagcctatggcgcaccggcgtcgatcaccagcttcgtcgtgccgaccggctactcctttaaccttgatggctcgacgctgtatcagagcatcgcggcgattttcatcgcacagctgtacggcattgagctgtcgctggggcaggagatcattctggtgctgacgctgatggtcacctccaaaggtatcgctggcgtgccgggcgtctcctttgtggtgctgctggcgacgctgggcagcgtggggatcccgctggaaggtctggcctttatcgccggtgttgaccgtatcctcgacatggcgcgtacggcgctgaacgtggtggggaatgcgctggcggtgctggtgatcgccaagtgggaacacaaatttgaccgtaaaaaagcgctggcttacgagcgcgaggtgctgggcaaattcgataaaaccgcgaattcctgatttgcttaaaagatgcccggcggcgcgagcttgccgggcctacggcgtaacatgtaggcccggtaagcgaagcgccacagggcaatacccctctctcgttaacccatcgcgctttcgcgcagactggcttttaacttatcgtactcggcgatcacatactgttccgcggcacgctggtcggcaatccgctcaacgttaacggcgcagtacttgtactccggcgttttggttatcgggcttaagttctccgtcaccagctcgttacaggcgccaatccaccactggtaggtcatgtaaatcgcgcctttattcgggcgatcgctgacctgcgcgcgggtgatgatgcggcctttgcgggagttcacccagatcagcgcttcatcttcaatgcccagacgcgccgcgtcggcggtgttgatctgcgcatagccaggttcatccgccagcgccgccagcgccgcacagttgccggtcatcgaacgacaggagtagtggcccacttcccgcaccgtcgatagcaccagcgggtactcgtcggtcagtttgtcgatgggcggcacccaatcgcaggtgtagaacttcgccagcccggtatcggtttcaaacttctctttgaacaggtatgaggtcccctgatccgcgtccgacgtatcgcggcatggccactggatataacccagctcgcccattttttcataggtggcgccatagaagtccgggcacagatgacgcagctcatcccagatctcctgggtgttgttgtagtgcatcggatagcccatacgggtggcgatctcgctgatgatctgccagtccgttttcaggtcccactgcggctccacggctttgaagaagcgctggaagccacggtcagccgcggaatacaccccttcatgttccccccaggacgttgacggcagaatgacatctgccgccgctgcggttttggtcataaagatgtcctggacgatcaccagctccagatcttcaaagcctttacgcaccgccgacagctcggcgtcggtttgcagtggatcttcccccatgatgtaggccgcgcgcacttcgccatgagccgcccggtgcggcagctcgctgatgcgataaccagtgtgcgccggcagactggccacgccccaggctttggcaaatttctcgcggttttccggcacgtgcacatattgatagccaggatacgtgtccggcagcgcgcccatatcgcacgcgccctgcacgttattctgcccacgcaccgggttaacgcccgcgtgtggcttgccgaggttaccggtcagcatcgccaggctggtcagggagcgcacggtttccacgccctgatagaactgggtgacgcccatgccccacaggatcgccgcgcttttcgccccggcatacagtcgtgcgcaggtgcggatctcctcggcgctgacgccggtgatcgcttccaccgactccggcggatagcctgcaacaatctttttatactcgtcaaaatcctgcgtacgcgcggccacgaaagcatgatcgtagagatcttcgctgataatgacgtgcccgatggcgtttagcagcgcgatattcgagccgtttttcagtgcaatatgcatatccgcaatgcgcgcggtttcaattttgcgcggatcgcagacgataattttcgccccgttctttttcgcgcggatcacatgattggcgacgatagggtgggaatccgccgggttatagccaaaaataaagaccaaatccgtgttatcaatttctgtgatggcattgctcattgcgccattaccgaccgactggtgcagacctgcaaccgatgggccgtgtcagacacgtgcgcagcaatcaacgttattggtgccaataacggcgcgcgcgaatttttgcatcacatagttggtttcattgccggtgccgcgtgatgaacctgtggtctggatggcatccgggccgtacttctctttgatggcggaaagtcggctggcgacgtagtccagcgcttcactccaggataccgcttccagtttgccgccgcgctggcgacggatcatcggggttttcaggcgcggggtcaggatctgggtatcgttaataaaatcccagccgtaatagcctttaagacacagggtaccctgattggtcttcccctgcgccgcttccgcccggacgattttcccgttatcaaccacaaggttgattttgcaacccgaggcgcaataggggcataccgtgacgacttttttcatcggtctcactccagttttcaattcgcgcatacgcgcacttgcccccgttatgcagtttgcatgccatattctttatgtgggtatttctgcgggatgcggagcaggaaggaagtgaaaaccctgacgaaaagcgcgccgtcgtcagatttgacgtgtcgaacgtcggggaagagctgtaggccgggtaagcgcagcgccacccggcgcaatcgcccctcacttgcgccacatcaacatttcagtgtgatcaattcttataatcatcatacttttcctgcacaggttccctgtcgtgttcacactccgctcgatcatcactggcgtactgctctgtttttccgctgtcgccttctcacagactgacccgacgacgctcaccaccgcctggccggtcaacgttggcccgctcaacccgcatctttacacccccaaccagatgtttgcgcagagcatggtgtatgaaccgctggtgaaatacgcggcgggcggcagggtggagccgtggctggctaccggctggacgcactccgccgacgggaaaacctggatcttcaccctgcgcgaaaaggtcactttttccaatggcgaacctttcaacgccgacgccgccgcggcgaatttccgcgccgtgctggctaaccgcgcccgccatagctggctggaactggtgaaccaaatcaccgatgtcaaagcgctcggtccgcaaaagctgcaaattacgctgaaaagcgcctactacccgtttttacaggagctggcgctgccgcggccgttccgctttatcgccccgtcgcagtttgtcgatggcggcacgaaaaacggcattaaagcgccggtcggcaccgggccgtggatgttgcactcgtcgcgcctgaatcaggatgatgtcttcgtgcgcaacccgcattactggggaaaacaaccggcgatcggcagggtgagggttaatgtgatccccgatcccaccagccgcgccattgcctttgaaaccggggaggtggatctgctgtacggcagcgaagggctgctacccctcgataccttcgcgcgctttagccagaacccggcgtaccacacgcaactttccgcgccggtagaaacggtgatgctggcgctcaatacccggcttgcccccaccaatgagctggcggtgcgcgaagcccttaattatgcggtggataaaaaaaccatgatcgccgccgcgctctacgacacgcagcagctggcggacacgctgttcgccccgtcggtgccctatgcgaatatcgggcttaaaccgcgcggctacgatccggcgcaggcccgcgccctgctcgaaaaagctggctgggtgctgcctgccggtaacgctatccgcgagaaaaacggccagccgctgcgcattgaactggcctttaccggtaccgatgccgagagcaaggcgatggcggagattattcaggcagatttgcgcaaaatcggcgtcgatattcagcttatcggcgaagaagagagcagtatctacgcccgccagcgggacggtcgcttcggcatgattttcaaccgcacctggggcgcgccttacgatccccacgcctttatcagttccatgcgcgtgccatcccatgcggattaccaggcgcagctggggttgccggataaggcgctcatcgaccaggaaatcggccaggtgctgacgcagcaggatgaaaccgcccgccaggccttatataaagacatcctcacccggctgcatcaggaagcggtctatctgccgctcagctatgtctcggtgatggcggtatcgcggcctgaactgggagccatccccttcgcgccgatggcgtcagagatccccttcgaacagctcaatccggtggcgcagccatgatgctgaactgggcactacgtcgtttgctgctgctgatcccgatcctgctcgccgcgtcgctgctggtgtttttgatgctgcatctgggcgtcggcgatccggcgatggactatttacgcctttccggcgtgccgccgacggcggaggtgctggccgccacgcgggagatgctcgggcttaacgcgccgctgccggtgcagtactggcactggctgatgcgcgccgcgcggctggatttcggcgtctcttatgccacagggcgtccggtgctcgacgatctgctgcattttctgcccgccaccctgcaactggcgggactggcgctggtgctgatcctggcgatctccgtgccgctcggcgtctgggcggcgcgttatcccaaccgcctgccggatcatatcgtgcgcgtgatcgctttcctcggcgtctcaatgcccaatttctggctggcgtttctgctggtgatgctcttttccgtgaagctgaactggctgccggcgatgggttacggcggctggcgctacatgatcctgccggcggtttccattgcctttatgtccctttcgatcaacgcccgtctgctgcgcaccagtatgctggaagtggcagggcagcggcatgtgacatgggcgcggctgcggggcttaacggcggcgcaaaccgagcgccaccatgtgctgaaaaacgctgccgttccgctggtcaccgcgctgggaatgcacatcggcgagctgatcggcggcacgctgatcgtcgaaagtattttcgcctggccgggcgtcggccgttacgccgtctccgccatttttaaccgcgactatccggtgatccagtgctttaccctgctgatggtgaccgtctttgtgatcggcaatctgctggtggatatgatcagcgccgcgctggatccgcgcgtgcgcagccacgagggacagcacgcatgaacacggtttttcttgcccgctggccggtgcgcatggcgcttttgatcatcgctctgctgtttatggtggcgctgaccagccagtggtggctgccgttcgatccgctggctcttaatctgccggagcgcctgtcagcgccggacagccagcactggctgggcaccgatcacctgggacgcgatatcttcagccgtctgctggcggccacgcgtatctcccttggcgcagtgctgctctgtctgctgctggtgctgaccatcggtatgatcgcgggcggcgcggcagggttgctcggcgggcgcaccgatcagctggtcatgcgcgtcgccgatctgtttatgacctttcccacctcgatcctgtcgtttttcctcgtggcgatcctcggcaccggcatcaccaacgtgatcatcgccatcgccctgtcgcactgggcctggtacgcgcgcatggtgcgcagcatggtgctgtcgctgcgccagcgggagtttgtgctggccgcgcgtctcgccggggccagccgggtgcggatttttattgagcacatcagcggcgcggtgctgccgtcgctgctgatcctcgccacgctggataccggccacatgatgctgcatatcgcggggatgtcttttctcgggctgggcgtcaccgccccgacgccggagtgggggatcatgatcaacgacgcgcgacagtatatctggacgcagccgctgcaaatgttctggccggggctggcgctgtttatcagcgtgatgagttttaacctggtgggcgacgcgctgcgcgaccacctcgatcccggcagggctttgcaggagagccattcatgaacacgctgaccctcgacgggttttccttttatgctgccggtacgtgcctggtggataacgtctcgctgaccctgcgccgggggcgcgtactggcgctggtgggtaacagcggctgcggcaaatcgctgacctgcaacggcgcgctgggcgaactgccgccgggcgtgcggcgcaccggcgggcaggtgttgctcgacggcagagtggcggcggcccatgaactgcgcggcaggcgggtatcctgcgtgatgcaaaacccgcgcagcgcctttaatccgctgcgcaccatccgcgatcacgccagggaaacctgtcaggcgctgggtaaaaacggcagcgatgccctgctgctggcacggctggcggatgtcgggctggagcaggccgcgcgcgtactgtcactttatccctttgagatgagcggcggcatgttgcagcgggtgatgatcgcgctggcgctgctcggcgatgcgccctttatgtttgccgatgagccgaccaccgatctcgacgcggtggcgcaggcgcgtatcctcgatgtgctggcggatgtcatgaaaacccgcgcgccgggaatgctgctggtgacgcacgatatgggcgtggtggcgcggctggccgatgaggtggcggtgatggagcaggggcggattgtggagcagggcacggtggacgatctcttttatcgcccgcagcatccgctttcacggcggctggtgagcgcgcatctggcgctgtatggcgaggcgttgccgcaatgacgctgatcgccatccaccaggtttcccacggctacacctcgtcagggttgttccggcgcgggcagcaaaaagccgtgctggaagacatttcttttgacatccgcgcgggcgaaaccctggcgctgctcggacgcagcggctgcggtaaaagcacgctggcgcggctgatcgccgggctggaaaaaccgcagcgcggcgaggtgcgctatcaggggcagaatattcaccgcctggcgcgcgccgacgcacagcgctttcgccaggatgtgcagatggtgttccaggacgcgctgagcgcggtgaatccacgtaaaaccgtagcggaaattattgccgaaccgctgcgccacctgaccagcctgtcggcagcggaacagcaggagcgtattcttacgacgctcaccagcgtggaactggacgatgcgttcatgagcaaactgccgtcgcagctcagcggcgggcaactacagcgcgtatgcctggcgcgcgcgctggcggtacggccgaaattactggtgctggacgaggcggtgtccaacctcgatctggtactccaggcgcacatcgtggcgctgctgaagcagctccaggcgcagctgaatatcggctttctgtttattacccacgatctgcggctggtgaagcgcttctgtcagcgggtgatggtgatggacaacggccacattatcgaaacccgcccggtggatgcgcagctgtgctttgcaacgcctgccgggatcgccttacagcaggcggtattgcccgcttttccggtacgctaacagaagggaattgtatgcagcgcatcaccatcaccattgatgatgatttactggcaacgctcgatcgtctgagcgataaacgcggctaccagagccgttcagaagccctgcgggatattgtgcggcaatcgctggcggaagaagcggcgacagaggccgatcagcacggctatgcggtgctgagctatgtctatgaacatgaaacccgcgagctgtcatcgcggctggtggcggcccagcatcagcaccacgatctgtcggtgtcgacgctgcacgttcacgtcagccatgacgactgtctggaagtggcgatcctcaaaggcaatctgcacgatattcagcactacgccgacgaaatcatctcccagcgcggcgtgcatcacggccatttgcagtgcattcctgactgattaatacatctcaatatgcgtatcacgcggcagcgccagcagacgttcgccgtgggtgagcagcagatcaatgcccagcgggaaggcgtgcaggcggtcggcaagagcatgaacgatgcagtgcggcagttgcggcgcgatcatgcgctcctcatgaataccaggcccggtcaggcgcagcatacgaccaccgcttaagccggaaacctgcacgatcagcgtgacagggccaggctgcgcggcggcggcagcgaaaagggcgtccagttcggcggcgctgagcgtatcatcggccagcgcaagggtggcgaaatgtggctcattcaccagcgctgcgcgggtgtgcaggcgcagattctggatcacaaaatcgttatgcagcggattcgacagccacaccggcatgtttttatcggccagcgtcagcagtacgctggaggtcgccagattgagtggctgccagccgtgttttaactggtgcagggcaacaattacccccggctcgctcatggcttttaacagacgacgaaaactgtgctgcgcgtcctgcacgttattattcatggtggtcatggaatgcatggagggctccatagtgaagatgagagccagagtggcaaggaagtatgacgtttgcgttaagcagagatgacggaatagtgaagctggcaggggaaaggcaggggcgggaacgttatgtgcccacccggacgatcagttctttttcacaaattcggatttcagcttcatcgggccaaagccgtcgattttgcagtcgatattatgatcgccttccaccaggcggatgttcttcactttggtgccgattttcagcattgaagagctgcctttcactttcagatccttaacgaccgtcacgctgtcgccgtcggccagcagattgccattggcatctttgacgatcagcgtgtcgctgtcttccgacgcgctggcgtcgttccactcgttcgcgcattccgggcagatgtacatgccgttgtcttcgtaagtgtattcagaattgcatttcgggcagtgggggagttgcataatcattcctcaataaaaggctaatgggggtggaagtccgtccaccgaaaaatggcaggctgccaaaaaggtcgaagattgtacaccaaatccttactgttgtcggtgctattcttttttcactaaaagtgatcgacgtgacacaccctgtcaggcagttaagccatgcttaacaggtgaggtattctgatgcatgaatgagcgctaattttcaatatttttcggtggaaattgccactctgaaccaattcatatatggtgagatcacgcatccagtgttattaaaaagcagctctcggcaccagctctgtctcctgccgaagtcggcgacttacctctcaatttgggtgggtaaataaatgaagatatatcctggtaactcttaaaattagtctacgcgctgttgcttttgtttctgacatgagcaaagtaactcgctgaactgcatcataatttagaattttttattgagtcacgtcaggtagttatcttttttcagatatttttccacgcgtaattaaaaaagccgacactacattaaacaaaccgctcggctaaataaaagttataaaaatttgcgttaaggaaagacttttatcatgcacacacagacaatatttgaattgagccaggaagccgaaaggttgttgcagctttccctgcataatcttcattcattacaaacgatgccggtagcaaagcttgatgatgcgttgattaccgatataaacaacgcctccaatgttcatcctttgcatttcagcgcgcgtggaattgacgcccagcaggcgacgctgagtaacgaactacgcaaaattacccgtctggagatggtgctcgctatcgtcggtaccatgaaggcggggaaatccaccaccattaacgccatcgtcggcacggaagtgctgcctaaccgcaaccgtccgatgaccgcgctgccaaccctgatccgtcatacgccggggcaaaaagagccggtgctgcatttttcccacgtcggccctatcgataccctgacccaacagttgcagatgcgactgtttggcttcgatcgcgagaaactggcgcagaagctggaaattgataaggacatgcagacgctgctggatcgtattcgtcagggcgatgcttttgataagcactatctgggcgcgcagccgatctttcactgcctgaaaagcctcaacgatctggtgcgcctgtcgaaagcgctggacgtcgatttcccgttttcttcttatacggcgctggagcatattccggttattgaggtggagtttgtgcatctcgccgggctggaaaaaaacatggggcagttgacgctgcttgatacccccgggccgaatgaagccggccagccgcatttgcagcagatgctgaaagagcagctggcgcgcgcctcggcggtactggcggtgatggattacacccagttgaagtcgatttccgatgaagaagtccgcgaggcgattgccgccgtcggcaagtcggtgccgctgtttgcgctggtgaataagttcgaccagaaggatcgcaacagtgacgatgccgatcaggtgcgcacgctgatcgccggtactttaatgaaagggcatatcacgccgacgcagattttcccggtctcctccatgtggggttatctggcaaaccgtgcccggcacgagctgctgcgtagcggtaaactgcccgatcctgaagaacagcgctgggtgcaggactttgccgaagccgccctgggccgccgctggcggctgaccgatctggatgacagcgcgcatattcagcatgccgccgaattgctgtgggaagactcgctgtttgagcagccgatccagaaactgctgcacgccgcccatgccaatgcctcgctgtatgcgctgcgatccgcttcgcacaaactgctcaattatgcccagagcgcccgcgagtatctggattttcgctatcaggggctgacggtggcgctggaaaatctggagcagaatatcgcccggctggaagaggatacccgtctgctgcacgcctgccaggagcgggtcagcgacgaagtgaatcatgaagtggaagatgcgctggctgccgccgatcgctttatcaatggcgagcaggcgaccattatcagcgagatcgaccactattttacccacagcgagcgaccggaagaggccacgcttattaacgctgacgaggagtttggcgtcggtaaactggtgctggaggatgaaagccaggcgcaggtggcgctgagtaaaatccgctccgcctgcgaggtgattttgctgggcgcgcaggatcgcatcagccgggaactggcgcagcgtttcgatcagctggagtacaccctgacccggtcgttacaggatgcgatgcgcccgattgaaacccgtataaaggaagagctgagccacgccggttttcgcgcgcgcatcagcttaccggcgtttcaggccagcacgctgaacttcaatacgcggcaactgtttgtggatgccatcgccgccgaagatattcctgccgggcagtcgcgcgtcagcggcgtgcgggacagcatgtcgcgctggctgaacaatccgggctggggctggaatgattatgtcgtcacccgtacccgttacgttatcgacgtgacctcgctgcaccagaacctgattaatcacgtcgcgcatttttgcgcgcagatccgtaaggcgctggcggcgcaggttgatgtgtccgtaacggcggggatggcgacctttttcgccgagttttcgcacagtttgtcggggttacaggaaagcctgcgtgacagcctggcgattcgtcagcagaatgaatcgacggcggcggcgctgcgtcagcatctccggcaatgcatcaccactgccaactggatccacgaagatgcccggttgctgcgcgatgatattcaaaccctgtttgcggcagatcaaccatgaaaaaccgacttctcgacggacccgggcagacgctggagtgcatccagccaaaatttattgtcgatctggtgcagggcattgatgccccccggcagacgcaaatcgtgccccagcaacaggcgtttcgcgaacggctgacgcaggagataatgacccagacgcagctgcgtccgtgggcgatgtccggcatgtatcatgaaaacgatgcgctgcgtctcgggctggtggaaaaactcgccagcatgttcgatccgggtcagctggcgctggcgcgtatcacgcagcgcctgacgatgttgcagcagaacagtgaacgtcgccccgggctgtctgccgcgctgcaaaaacagtatgacgatatgctggcgcatttcagtctgcgcgccgcctcgaaagagaaagccctgacccagcgcgggctgatggtgcaggccggactgcacagcgagcagatttttacccgctggcgcgccgggaaatacgatggctggtcgctggccggacgctgttttatcgcgctggaagagctgcgctggggcgcgtttggcgatgcctgccgcttaacccggccggaagtgtccagcctgttgaaagacaatctgcgcattatggccgccgattttatggcgcaggggataggggcgtcaccggccacccgccatttctatcatcaatggttaaccacacccgccacgccgggcctgatggataataaagatctgctgggctggttgggggactggtgcgatgtcgatcgtcatccggtgtgctggtcagtgacgcaaagctggcaaacggtggcgctgggtatgccgcggctctgttctgcgacgcgtctggcgacggcgctggtggaggaagtctttagcgagggcgtgtaattcccctcccgccaggcgagaggggaaatagtctgtcagtgatgcagcgactctgtcgctttctcttgttcaaccgccgcaggcgattgttgcgggttgccatagcgcttcgcatagagcgcggtaatgatgggcaccagaatcgccgtcacaatcacactggctgccaccagcgccgtagctgatgcggctaccggttcgaaggccgggttaatctgcgcgataatcaccgggtttgccaccgccgcgcctgccgccgatgacgctgccacgcccgccgtaccgttaccaccgccaatccagcggtccgccaggatcagcgggataccggtaatgatgatgaccgccacgcccaggaagatccccagcagaccggtattcaagatcacattcaggttgatggtattccccagcgcgaaaccgaagaacgggatcagcaccggcgtcgctttgctgaagaatgcgcggaaatcgtgatcaaggttgcccagcgcaaaaccaatcaggaacggcaggaccgcgccgataaagtgatgcggttcgaaggaggccagaccggcggatccgaggatcaccatggtcatcagcgggccggattccagcgacatcagaacgaaggcgccagactcttctttggtgccgtactggttcatcaggctggcgtacaggccgccgttggtcatatccatggcagagacaatagccagcaccgacagcccggcaaagaagcccgcctgaattccggtttccggaataaaggtggcggcaatcattgccactatccatgccacggcaattttagtgatcaccagcgtaccggatttacgcagtaccgtgccggtagcgcgtaaatcaatggaggcgccaatacaaaagaaccacactgccagaataggcaccgtaccggtgatcattcctttcgtgaaggaaccaaaataagcgccggtatccggtgccagggtatttagaattgccccaagaagcaggggaaccagcatcatcccgccggggatgcgttcgatcgtggccttgattttcattgaagatcctcacgcttcaccgcgccatgcgcgcgataaaagctaaaaaatgtaaaattaataaaatcaatcagatagttcgctgatgagttgcgtttatctcatcgcggggatcgcgttatatgccgacaggtgccgccagtgctttcctctttaagtgtgcctggcgctatgatgcagtcatcggaatattgattcaatgaaaacgaaacagtgttttagttatctggatcacatatttcacgtaaagtttcttaaaggctccagatattaaaaagcctgtaaatgagttgtaaaaataaggtgtttttgaccgggttagcgattcgtttgaggatcaccttattcccataaaaatgagggttttgtcagcggtgggtaaatatgtgtgaagttgatcacggttttaaaccctgttagggtaaagaggtcattaactgcccgaacaggcgtcaacaggtttggctgtccagactttaaccagcttacgtaaccaaacctgctacgcttgatattaaagaacgcaatcacccggcaaccattaactgtgtagtgtaatgacgagagtttttacgcttccgtcggctgtgcgttcagggcaaagtccatgaggataaagaatgttaaaaaggaaaaaagtaaagccaatcacgctgcgcgatgtgaccattattgatgatgggaaacttcgcaaagcaatcaccgccgcatcgctcggtaatgcgatggagtggtttgatttcggtgtttatggatttgttgcttatgcgctcggtaaggtcttcttcccggatgctaaccccagcgtgcagatgatcgctgcgctggcgaccttctctgtacctttccttattcgtccgttgggcggattgttcttcggcatgttaggcgataagtatggccgtcagaaaatactcgccatgacgattgtcatcatgtccgtcagtaccttctgtattggtctgatcccctcttatgcctctataggcatctgggcgccgatcctgctgttgctgtgtaaaatggcgcaggggttctcggttggcggcgaatacaccggggcgtcaatcttcgtggcggagtactctcctgaccgtaagcgcggctttatgggcagctggctggatttcggctccattgccggtttcgtgctgggcgcgggcgtggtggtgctgatttccaccgtcgtcggtgaagagaacttccttgactggggctggcgtctgccgttcttcctggcgctgccgctgggtctgattggtctttatctgcgtcatgcgctggaagagaccccggcgttccagcagcatgtggataagctggagcagggcgatcgcgaagggttgcaggacgggccgaaagtctcgttcaaagagattgccaccaaacactggcgcagcctgctgacctgtattggtctggtgatctccaccaacgtgacctattacatgttgctgacctacatgccaagctacctgtcccataacctgcactattccgaagatcatggcgtactgattatcatcgccatcatgatcgggatgctgtttgtgcagccggtgatgggcctgctgagcgaccgttttggccgccgcccgtttatcattctgggcagcgtggcgctgttctcgctggctattccggcgttcattatgatcaacagtaatatcatcggcctgatttttgccgggctgctgatgctggcggtgatcctgaactgcttcaccggcgtgatggcctcctccttaccggcgatgttcccgacgcatatccgtttcagcgcgctggcgagcgcctttaatatctcggtgctgattgccggtctgacgccaaccctggccgcctggctggtggaaagctcagagaacctgatgatgcctgcctattacctgatggtggtggcggtgattggtttgattaccggtattaccatgaaagagacggcgaaccgcccgctgcgcggcgcaaccccggcggcgtcggacattcaggaagcccgtgagatcctgcgtgagcatcacgacaatatcgagcagaaaatcgaagatattgatcaggagatcgctgaactgcaggagaagcgtacccgtctggtgcagcagcacccgcgtattgacgagtaatcttcccctcaccccggccctctccccatgggagagggttaacatcccgccgcaataaaatccccgttcgcgctcaccggtattaccgttaaaaacagcactgaggcaaagaggattatcgccatccccccggcgattttcagcgccggaacaatccatgtctggcgctgcccgccaaacagcgccgccgtacggttgcgggcatagcgtaccgccagcgacaggccgatgatcgaaagaccggtgccgagcgacatggtcatcaccgctgccatgccccagctgaccatgcccagcgcattcgaaaacagcaaaatcatgatcgccccgctgcacgggcgcgcgccgatagagagcatcacgcccgcgcgcgttttccagtcgccgctggtggctaagcccacgccatgatgatgaccacagccgcagtccggcgcgtgtcctgtgtgaagcggtttcatgcgatggatacgcagtccgcgcgtggggaggcttctggcggcctgatagatcacatagcagccgaagccgccgatcagcagcgcgctgcttttttcgacgtaccagcggctttggctcagatcccccgacgccaggttaaagccaacggcgaggataaagacaaaggcaatggcgctgacgccctgcaacaggctaccgaaaaacgggatcagccgcgccgccagcgggctttcctgattagtgccgagccaggtggtaacgataaatttgccgtgccccggcccgatggcgtgcagcacgccgtaaaagaacgcgccgaccagcagccacaggccgccgctcagctgatgattattgagttgcagcagatacatcaccagataacggtgcagcgtgatctgcgtgctcaggcaccactgcaaaaaagcgccccagtggtggtgcaacagcagaagagccgccagcgcgataagggtgcaggttatcgcgccggggagccgccatgagcgggtcagtgctggagtcatcataaatgcccgtcgggaaatgatgaccagagtatagaggttaggccgcgttaaggtaacgggataactgccgctgatggtaacgcgccagcagcagcaccgtggtcagcgcacccagcagcgcgcagaacatgtctgactgggtatcccagggatcgccctgggtgccgaggaaatcgtccgcgccctggcccatcgccagtgccgcccaccactcgatcagctcatacatggcgctgatcgccagcgcaatacagcacaccacaaagccgagcattttccgcccgcgcacaaaggcaccgcgcaccaggatctcccgcgctgccagcgccggcaccagcccctggaaaaagtggccgagtttgtcataggggttgcggtcaagcccgagccacgcctgcacatcaaagccaatcggcactttcgcgtaggtatacataccgccgaccatcagaataatggcgtggaaaaaaatcagcgtatacagcaagggggtgaggggatagcgcgcgtgggtggcccacagcaggggaatgaggatcagcaccggcgtgacttccatcagccaggtaattttatcgccagcgtaaataccggtgtagacaacaatcagcgccagcagcagggctgcgacttttaacagagaggatggcatgggttttcatccggatgaaaaccttaactattgaccggaacggccgcggagacaacctgaaaataacaggggccgttaccggccccgtggaattaaatcagaacgatttgtttaaacgcaggctgaaggtgtgcgcctggtaagtatcgctggcctgaacatcgtaacgggcgtcgatggtcagatcattggcgctgtacagcgtggtgcccactgccagtcccgccatatctttcaccggcgacgcgcctttggtggtgaactgggtttcgcccagggtatcggccacgtaggacgcattattgctcatgcgacggttatcgtactggtggatccaggagatctgcgcaaacggcgtcagcgcgcccagcggggtatccacggttttctgcacgcggacgccgatatcgctgattacggactgggagtgcgaggcatcaacgtccagcgccatgccgttgccaccgctttccttatagccatcaacatgctgatagctgtaagccagtgcagccagcggcgtgaccacgacctgcgcaggcaacgtcagcggataaccgaattcgctttgcagcgtgacggattgaccgttgaatttgcccttcgccgtgccggagaagccggtgaaatcagcacgacgcaccgagtcatagttctgacggttcactgccgcagacagattcaggaaccacggattgccggtgtaagccgcataaccaatcacgccgtagttgtcagcggttgaggtgttgccgctcaggttgtttttgccgtgcaccgaggtgttgctgtagttcatcgctgcacccacgcgccagtcgtcgcccagcgcgcgatcggcaccgaggatcaggccgccgaatttcgcgctgtagccgctgacgtcgtcggtggtgtcctgacgggcataaccgccgaacggctggccccagacgatccagttgctgtagtcatcaccggtggataccccgctggcgcccgccgtctgcggattacgcacggtatccatatgattgcccaccaccgacatcgccgtggagttcgccacgccggttgccgtgctggcgctgatgctctgcccggtggacagacgttcgccgacgcggttcgcttcctgctcgccgtcaatggccagcgaggcgttgtaaagctcaagcagctgcggagagataccggagtaattcgccagaccacccagcgacgccgtggcgttaggcgtggttgcccgtactggctcagcaggctgcggttcagcaggagcagtcaccggcggagtcaccaccacaggcggcaataccggggtagtgacgaccggggtggtcacttccggcacggtaacgaccggcggtttttcggcgggtgtcgtgacaacaggcgttgtttccaccggggtgatgaccacaggcggcgtgaccaccaccggcgtctcgacaggcacgcttacttcaggcggtgtaaccacgaccggtggtttttccagggttaccaccagcgcactgttcgtattatcggtgacggtggaacctgtcacgaggccgtcatagcctgcggctttatagttcagtgtcccggcgttgtagtttgtgttagcgctgttcgcgtcgatcaccacataacgctgacccgccgcaaactgataggtgttgccggtacgcgcgagggagacgctggagccagcatcaacggtagccgcgccgctgacaaccagacggccatagctggtgtcggcagctttatcgccggtcgcgatcgcattatcagccacgccaaggatcagcgcgccagtggcattctgatggtaattaccagtgatattcagcggggtgttcacctgcagactggctgcgtcgttcaccacagtgcctggcgtgttgatgttatcattcagcagcagcgagccggagcggaagaagacatcgctggcgctctggatcttaccgatgccgttggtgccggtcagtacgcccacgttattattactaccgccgataatttccagcgacgcgccgttatcggagcgtaacgtgcctttgatcgtgccgctgttggccagcaccatggcggagccattattaccggaggcatgaattgcataggttgtgccggtaatagtgccgttgtttaccagattcagggtgctggtgttattcagataattgtaactgtagatcccgtaggcaccgctgatcagaccgttgttaatgatcacgctgcctgcgttattgttaatagcggcattattccggttatataacccgacaagggagccgctaattttactgttattagtcagcgtgttaataaggccgtcattgcggatccctatataggcactcttaattgtaccctcgttattaaaggtaccgatctcacccgtattgtagaccgcagcattattaccagcgttattattacctgtataggtaatggtgccggtgttattcagggtgccgatagtgccttcattccagataccgttagactgcgtatacatattcgcattatcagcgctgatgctaccgtcgttattcagcgtattaacggatataccctgcatgacatgaagcgcggagccgctggggggagcggtggcagaaccctgatcggtaataatgacccgatcgtaagcgttggcgatctgcacatcggactgtggggtattaatggtgtaatcactcgatatagcgagtgcgtgtggtgccagcagtccttgcgcggaggttaaagcaaccagcaaagatccttgctggcagatacgtaatttattcatgatgtaccattgcgatgtcgcgctgtttgtaaaaagtatgtgcgggtagtaacactgttcagactaatctgaatttgtctccggcgcagaacacccacttaatggctaacaaaacaataagcggtgcttaatgatttatcggcggaattaaggcgtactttaatatttaacttaaacctctctcgcgtggagccaggaaatggtaataaatcgtgggtattttaaagctgtgttattgattagcttcgttttattgttaagcggctgtactacctcggatccccgcgagactgctagcacacttgcgaaaaaacgccagctgacggcgcgagaattcgtcacggactggattactgtgcgcggctggcagcgcatcacgccgccggttacgcgtctgcgggtatatatcgaaggggatggttttgcctgggtcagccgcacgcgcccgtctgacgattcgacgccgcgtaacccggtgggcctgcaactggcggcggcggatccgtcggcgaacgtgctgtatctggcgcgcccttgtcagtttatcggcccgccgctgcccgccgcctgtcagccgcgggtatggacggatcagcgtttttccgccgcggtcgtggcggcgatgaacgcggcgttaagccaggtgaaggcgcaatatccgcaggcggagtttgagctggtgggctattccggcggcggcaatatcgccgcgctgctggcggcccgcaggcaggacgtcatcgcgctgcgcacggtggcgggcaatctggatgtggcttatgtgaatgcactgcatcatgtcaccgcgatgccggatgcgcagagcgccattgatgttgccccggtcctgaaaaacctgccgcagatccactacagcggcgcaaatgacagtaccgtaccgcccgccgtggccggacgtttccgtcaggcgaccggcccgcgctgtacgcaggtggcggtgatccccggaatggatcacggtggaaactgggcggcgctgtggccggaactgctggggagaaaggtggggtgcgggtgagcggcttaatctgcttcgacgagggtggagaatctgagcagaacatcgttaacaacggcttcgtccaggacttcaacaaaccgggcgtcgcgggcgttgagatcaatcatccgggcctgattgagaagaaccaccccctgcgttttactgccagagccggaaagcgaaacggtaaacccggcatgacgggcataattaccgccctgagtaaccggtgcgacgaacgccatgcccaaatcgttaaacagttttttcgtaagaatcaatgccggacgtggttcccgctgttcgctgccaacagcaggattaaaatcaaccatgactatatcgccgcgctgccatccctgcttacgctttaccatatttcattccccactggcgcatccttaccccatatttcttcttcgctggttgctggtgcgctggcatcgcactgtgcgaccagttcttcaagcgtatagcgttgacgtactggcgtcagaataagcgcgccgtcccggacttctgcatccagagactgaccagcgctgacacccagttgcctgagaagcagggcgggaaggataacgccattactgtttccccattttttgattgcaatgctcatcgcgaactccccatttgtttatacaaagtataactttcgggcatgaggtgttcaacatactcgcagataaactgtcaccagtaacgccagcagagtgcgcagaaggcattgttaacatcgccgaaagggtacgacagtttttggaccgtctttgcgaggcgcgccgcaaatcgcgctactgtttccgcttgccgttaatcgcgtctggcagtagcatcttcccgcacctgcaaaatcaggtgccgggattggtctcctgatgttaactcgttggcgacattgatttttatgtcgtgcgttctgctacatctcaatggtgggctgaacgggggcgccgcaaggtgcgccggtagccaacgagaccggtaagaccaactccgttcagtcccaccacccataagattggtctcttacgtggtgggttataaaacctcgttggagtctacccttatggctacctatatagagcagtccaataacttacttaccgttcccttcaccgcagatacagatttcaccgtgctggcggatcactgcgagcacttcgccgaagcgctgattgaaagcgatgatacggcgctgcgcctcgccatgtgcgggcgactcaatgcctgtctgacgctgctgcaacccacgctcaatgatgccatcccgccgcatcttattccggcgctcacggttgataccccgcctgcggaaccgccgcgtttcgaaccggaatccgacctgctttgtgaatactgcctgaccttaacgcgcgtactgaacagccagtcgctgccgccggatatggagaaaactcttacaggattgctgtgtgaactggtgtggtatttcgccgacatgatgaaagcgccgcgctgggtaaaaggtgtgtaagcgtagcctgctgtaaaagcttgccgggatcatgtaggcccggcaagcctgcgccgccgggcaagcagagttgaacagataaaccctgtcacaacattggtattttgcatacgatattattactgacctgaaagcatgccggaggacaacatcatgtcagcgaaacgcattatgtcagttaaatacgaaccactgactttgcgcattaagcccgccgaaggagagatgatcggtcgtgccgctggagaagcgctgatcgatcagcgcattatcatgatcgatcctgattcctgtcagaaatttatcatgcggatgggtcagatcccttcccagaatgtgtcgcttcgaaaaaccatgcaaactgccgccccgtgggagcaaaaaaaatgatcactaccctgagccagtgcaagccagcagattgatcccatgatgttaatggtgacgttaggggatttgattgagagcttaacgctacgcaataaatagaagcgattaaatgggatgccagaaagcaaaaaacccgccataagcgggtttttctgaatagtggtgcccggactcggaatcgaaccaaggacacggggattttcaatcccctgctctaccgactgagctatccgggcaacggggcgcattaaaccttaatcgctttacggcgtcaaccttatttccggaaatcgcatttatttgcttaactttacggcagtttgctgcaatctcagccatttttcgcctggctgcacaaatcttccagacattccccacgcggctgtgaatgctacactcggagatccgggaggacatatggcacaagactggctggagctgcggcagcacgacgaaaccggcatagaaacgatccgcgcgcactttgaagggcacgcctacgatccgcactggcatgacagctatctggtgggaatgacgctgaccggcacgcagcagtttcactgccgccgcgaacggcatcgcagtacaccgggggatgcctttttactggagcctggcgagatccacgacggcgacgcgccggtggcggggggctttacctatctgactttttatctggatgaacgctggctcgccgataccctgcgcgggctgtatgacgccgtgccttcgagctattcgctgcattttaaccgcaccattgcccgtgaaccggcgctcgtgcgggccatcgcgcagacgtttaccgcgctgcacagcgatgagatgcgcattctgcaacacagcaccatggacaatctgttaagccagctgacacagcactgccagtggcgcaaacggctgccggagcaggtgcagagcgcggccattgcccatcgcgcgcgggattatctgtatgcttttgtcggggagaatatcggccttgacgatctggcgcgggaaaccggcaccgatcgcttcacgctgacgcgctgttttaaacgggagtttcatctgtcgccccacgcctggctgatccagctgcggctggcgaaggcgcgggcgatgctggcgcagggggagcagcccgccagcgtggcggcggcgctcggttttgccgatcagagccatctcgggcgctggttccagcgtgcctaccggctgtcaccggcgcattaccgcaggctgtgcacaaatcttccagacccgcgcgcaaaataacgccacagtcagggcatcacttataaggagccctgcctgtgaatctgttgtctgcgtatctgccgtttatgctgtttgcctttgtggcgtccatcacgcccggcccgaccaatatcctcattctggccagcagccagcggtttggcgtcaaagccacgctgcctgccgtggcgggggcctgtctggcggcgagcctgattgtctttgtctccggcgcgggcgcgggggaggtgctgcgggattatccgctggtgcgtacggtgatgagctggatgggggcgctatggctaagctggatgagctggcaattgtttcgcgccccggcggcgcagtttgacgaggcgcagcggcccttcagcgccagatcggcggcgctgttacagttgatcaatcccaagacctggatgatggcgctggcggtggtgagcctgtttgcgccgcacggggcgcatccgctgcggaacatcaccctgttatcgctgttgtttttgctgatttcggtgatctgcctgagcgcctgggcgttgtccggcaatgcggttaaccggattttccgcactccggcggcgctgcgcggctttcagcgggcgatggcgctctgtctgttgctgtcagcctgggcgggtttgctgcactgagatcaggtcagcgcgccgccctgacggcactgggcgaaacgcagaatatcttcggccaggcgctgggcggtgtcgacatccgtctggctgcggttaaccagcatccggctgagacagccttccagcaccagctccatttgtttggcgaccataggcgcatcttcaatgccgatctttcgcagcagatcgtgcgagaactcataggccgcgcttttttgctgcgccgccagttgatggatcgggtgcgccggatccgggtaaaaggtacaggcggcgataaacaggcagccgggatagcggtgattcgcgacgcattcgctcagcgcgccatagcgggccagcaatttttgctcgaggctgaggtcgtcgttcagcagcagttgcctgcgccaggtatcgacctgcgtgctcagataacgcagcgcatcataaatcagcgcgtctttatcgggccagaagcgtaaaaattcatccagcggataattgatacgttcggcgatcatctctggcgtggtatcagcaatccctttaagttcaagtaattgcagagtgttccccaaaacatcttcgcgttgcacggtgtcctcctgcgttattgaaccgtttttcccattcacagtgtcgtttacggctggcgattgcgcaaatgctcagcgaaggccgcagcatccataaaacccgccacccgtaaggcggattgttcgttgccctgcgcatcaaagaacaggatcgtgggcagaccgggaacatgcagcgactttaataaagcagcatctgccgcggtgttcgccgtcacgttggcctgcaacagtacggtatctttcagcgcttcctgaacatgcggatcgctgaaggtgtacttttcaaactctttacaggccacgcaccagtcggcgtacagatcgagcatgactggtttgcccttcgcctgcgccagcgcctgatgcagcgcatccagatccgccactggcgtaaagttaaggtgcggcaggttctgcgcggcgcttacgccaaaggcccagtcctgcaacggcttcgcgcagatcagcgcgccgcccagcagaacaacctgcacgatgcgcacccacgccgcttttgccgtaaggctggtgataaacgcccagcagaaaaaggcgacgcccagcatcgaccacagccgcagcccccaggtatcgcccaggacacgctccagcaaaaacaccggcagagcgaggatcacaaagccaaaggcgattttaacctgctccatccatggcccgcttttcggcagcaggcggttgccaaagacggtgatcagtatcagcggcaggcccatgcccagtgcgtacagatagagcgtgccgccaccgagccagaggttgccactctgggcgatgtacagcaggatggcactgagcggcgcggtggtgcagggggagcaaatcagcccggcaatggcccccatcacgaagacgccgccgggtgagccgccctgctggcggttgctccacagcgttaagcgtgtttgcagcgcggaaggcagctgtaaggaaaacaggccgaacatcgacagcgccagcagggtaaagaggatcgccagcccgatcagcacgtaggggtgttgcagcgccgcctgaaactgcagcccggcggcagcgacgaccaggcccagcgcggtgtaggtcagcgccatgccctgcacataaatgaacgccagcagcagggcgcggcctgtgcgaaggcgctgtttgcctccgagcacgatgccggaaatcagcggatacatgggcagtacgcagggggtaaaggcgatgccgatgccgatcaacagcgcccagagggcggaaaagggcagttcaccggcggcggcaggctggctcgctgggagcggcgatgcaggcgttgcggcagctatttccgtcagcggcaccgttttggtttccggcggatagcacagcccggcctcggcgcagccctggtaagtcacggtgagcgtggcatttttacccgcggcattcaccgtcaccggcacatccaggcgctggcgatacacttcgcttttaccgaagaactcatcttcgtgcatctcgcccgcaggcagttgcggcggagcgatctccgcaccggcaggggtgattttgatctgctggcgatagaggtagtagccctctttcacctgccagtgcagcgtcaggtcgtgctggttttgctgaaaatcaaaggcaaaggcctggtcggcaggcacaaaactggaacggcccggggcgtcaaacagcccggcgaaggccgatgtgctgcacagcagcaggatcagcgtaaggaagcgttgagccatgagaggtaatcactatctccgtgtgtaaccggtaaaaccagtaattcaggggtctggtaagggtggtgcgatttcaggcaggcgagcagcgcctcctgatgcgcgagatcgcttttcagcagcatctgcacttcatattcctgctccagtttcccttcccagtaatagagcgaggtcgcgcccggcaacagggtgacacaggcggcgagtttatccgccaggactttggctgccagatcctgggcagtggcttcatccggggcggtacagagtacaacaacagcgtcaggcgtgttcatcgtcaatctcgactcggcgaaaacaggcactatagcaggtgacgggcggggattcatgcaacgggccgcgggacggcccgtttttaacgagatttacaacaggatgccgccgacgataaagccgaggatcacgcacagcgtgatggcaataacgccggggatcaaaaaggcatggttaaagacatatttgccgatacgggtggagccggtgtcgtccatttccaccgctgccagcagcgtcggataagtcggcagcacaaagagcgccgataccgccgcgaaagatgcaatggcggtcagcgggctgacgcccagcagcagggcggcaggcatcagcgctttggtggtcgccgcctgggagtagagcagcgtggcggcaaagaacagcaccaccgccagcatccacgggtagttatgcagcagatcgcccgccaccgtctgaatatcttcaatatgatgcttcacgaaagtgtcgcccagccaggccacgcccagtacgcagacgcaggcgctcatgccggatttaaaggtgctggcgttgaggatctcgccggtatcaattttacaggtcaggcagatgagcgtggcgatggtcagcataaacaccacaatggcttcgttacgcggcagcaccgggttggcgataagccctaccgtcgggctgatggcggtggcgtaaaccataaccgcgacgatgccgattaaaaacagcatcagcgaacgcttcgcatgaggtttgatgttaaacacctggctgccgcgcaggctgacttcgcctttcgccagtcgctcctgatacaccggatcgtctttcagctcgctgccgaggaagttacacaccacggcggtaagcatcaccgcaaccagcgtggtgggaatacaaatcgccagcagggtcagatagctgacgcccagcggttcaaggatgccggcaaagaacaccacggcggcggaaatcggcgaggcggtgatggcgatctgcgaggcgaccacggcgatggataatgggcgggacgggcggatgccctgttctttcgccacttcggtgatcaccggcagcgtggagaaggcggtgtgcccggtgcccgccagaatggtcataaaccaggtgaccagcggcgctaaaaaggtgatgtatttgggatgccgacgcagcattttttcggcgaggctgaccaggtaatccatgccgcctgcgacctgcatcgcggcgatggcggcgataaccgccatgatgatttcgataacgtcaaaggggatcgcgccaggcgggatttgaaaaaagagcgtcaatacgagtacgcccaatcctccggccagcccaatgccgatcccgccaagtcttgcccctaaataaatcgccagaaggacgataacaagttctgcaccaaacatagttgcctgccttgtttattaacaagttgatattagattgttgtattttagtaactcttaaaaagcaaaaaggcacgtcatctgacgtgcctttgtttgcgtggcgaacaattactgctcgctttcatcggtgtagcgtttggccttatagaccggatgcatcaggttatgcggcgagaagatgtcatccagttctgcttcagtcagcagaccgcgctccagcaccacttcccgtacgctcttaccggtctccgcacagatcttaccaacaatatcaccattgtggtggccgataaacggattgagataagtgacgatgccgatggagttgtaaacgtagctttcgcagacggcgcggttagcggtaatgccgttgatgcatttttccagaaggttgtaacaggcgttggtcaggatgtggatggattcaaacatcgcctggccaatcaccggctccatcacgttcagctgcaactgacccgcttcggaagccatggtcacggtggtgtcgttaccgatcaccttgaagcatacctggtttaccacttccggcaccaccgggttcactttggctggcatgatcgaggagcctgcctgcagttccggcaggttgatctcgttcagacctgcacgcggcccggaggagagcagacgcaggtcattacagattttggagagtttcaccgccagacgtttcagcgagctgtgcaccattacgtaagcgccgcagtcggaggtggcttcgatgagatcttccgccgggacgaccggcaggttactgacttccgccagcttctgcaccgccagctgctggtagccgtccggggtgttcagacgggtgccgatggcggttgcgccgaggttcacttccagcagcagttccgcagtacgacgcaggtttttggtctcttcgttcagcagcacgttaaaggcatggaactcctggcccagcgtcatcggcaccgcgtcctgcaactgggtgcggcccattttcagtacgtcctggaactcaacggctttattctggaagccttcgccgagctggtggatggcatcgatcagtttttcgatcgaagcgtataccgcgatacggaagccggtcggataggcgtcgttggtggactggcatttgttaacgtgatcgttcgggttgaggtactggtactcacctttctggtggcccatcagctcaaggccgatgttcgccagcacttcgttggtgttcatgttgacggaagtgcccgcgccgccctgataaacgtcaaccgggaactgatccatgcatttgccgttattcaggacttcatcacatgcggcgataatgacattagccacgttcttcgggatggtctgcaactccttgttggccattgctgccgctttcttaaccatcaccatgccgcgcacaaactcagggatgtcactgattttgctgttactaatgtaaaagttttcaatcgctctcagagtgtggacgccataataggcatccgctggtacttcccttgtgcccaacaaatcttcttcgatacgaatgttgtttaacatgtgaaccttcttaaattaaagctacgaatgaatgcaccaaacacacaggagatctgtggttatgtgtgattactgaccgacgattatttccttaatcagccacgtaaccgggatcatatgctgatcatagcgaattgccgtaacctggatcacttattatcttagctgatacggtacttttattgatttgtgaaatacatcaccggatcaatcattgccaaaaaatagtcgcgcattccgattgaattctggcatgaagcctccattacaggatcatgcgtgtcgcaaaattacactgaccgtggcgcgaaagccgcggtttacacaggagaagccagtgcgctggataccgttaattgccgtatttttatatgtttacattgagatttcgattttcattcaggtcgcccaggtcttaggcgtcctgttaacgctggtgctggtgatcttcagttccgtggtcgggatgtcgctggtgcgtaaccagggcttcaagaatttactgctgatgcagcagaaaatggcggcgggtgaaagtccggcagcagaaatgatcaagagcgtgtcgctgatcatcgccgggctgttgctgctgttgccgggcttctttaccgatttcctcggtttgttgctgctgttgccgccggtacagaaactgctgaccctgcgcctgatgccgcatctgcgtttttcccgtatgccggggggcggtttcagcgccggtacccagggcgggcagacctttgatggcgaataccagcgtaaagacgatcagcgtgaccgcctcgaacataaagacgatcaataattacttttgcccggtggcgctgcgcttaccgggcctacaaattacccgttccagcaattgtaggccgggcaagcacagcgccgcccggcatgtttaatccacgcgccgtttgggtaaaaacagccacagcgccgccagcatgatgatggcgtaaaggctcttccagccgaccatcgccagcagcagtaaacagagcaccccgccaagcgccgccagcgcacgataacgcccggtcagcagccgacatcccgccagcatacacagcagatagatcatgatgaaaatgccgttggcatagacaatcagcgcatccagattgatatccagcagatagatacccagcgtgctcagcatgcagcagccgatcaccgcgctgagggcgttacgcggaatgtggtttttcgaaaggcgcgccagatagctgtccggcaggtgctgcgcctgcgaccacaccagccgcgcgaagctctggatataaatgttcagactggcaaagcaggccagataaccaatgacgcaggcgatccacagggctttcacgccaaacagctgcacgacgatgcccggcaatgaagtcgcggcggcgcgatcggcgctgtaggcattaaaatgcagcaccagcacggtacaggcccagtatacggttcccgccagcagcaggccaatcatcagcgcgcggggaaaatcgcgctccggctgtttgaattctgacgccagatgcgcaaaagcctcaagcccgacgaagcaccagaacatcaccgacagcgcggcgaacagctgcggggtatccacctccggcagcgccgggaagggaatggccgcgagggtaatatcgccatagatccagatcgctacaatcagggcgacgatcaaaatcgccaccagggtttgcaggttggcgctggagcgcgcgccccgggagccaatccaccagatgatggcgagggtgcccagctccgccagcaataactggctgtcgtgccagccgaacagcgactgcccaaaaccggtggcgatgtgcagcgcggcgggtaatcccaccgggatcaccgacaaaaatagccagccggtgacgcgcgccagccgggggccaaaggccagggcgacaaaatgcgccacgccgcctgcgctgggaaaatgtcggccaagcagggcaaaaacaatggcgatgggaaacaccagcacgatcagcgcaggccaggcccacaggctattatcgcctgctaccagcgccgccagcgcaggaacggcaaacacgccggtgcctaataatgaagtagagagtaagcccaccccttgcgctaatcccaattcctgttttaatccgctcattaccctgtcctgccgccatcaaagagcggcgatagtagcataagcaggccttatcagcgccgcgtgttccctccccacttctggcaggacgttgtttcaggcaactttttatcgcccttaagaaaatttttttctttttgccccttgaaggcttgatcaagcacccccatctctgacgtcaccagccgggaaccacctttaggccggcgtcatccataaccgatactgactttctcaaaggagagctatcaatgagtattcgtccgttgcatgaccgtgtcatcgtcaagcgtaaagaagttgagtccaagtctgcgggcggcatcgtactgaccggaagcgctgctggtaaatcgactcgtggcgaaatcatcgctgtcggtaaaggccgcatcctggaaaacggtagcgtgcagccactggacgttaaagttggtgacatcgtcattttcaacgatggctacggtgtgaaatctgaaaagattgacgatcaagaagtgctgatcatgtccgaaagcgacattctggcaattgttgaagcgtaacccacccgcgaactgaacctacgaatttaagggaaagaagaaaatggcagctaaagacgtaaaattcggtaacgacgctcgtgtgaaaatgctgcgcggcgtaaacgtactggcagacgcagtgaaagttacccttggcccgaaaggccgtaacgttgttctggataaatctttcggtgcaccgaccattactaaagatggtgtttctgtagcacgtgaaatcgagctggaagacaagttcgaaaacatgggcgcgcagatggtgaaagaagttgcctctaaagcgaacgacgcggcaggcgacggtaccaccactgcaaccgtactggcacagtccatcatcaccgaaggcctgaaagctgtagcggctggcatgaacccgatggatctgaaacgcggcatcgacaaagcggttatcgctgcggttgaagaactgaaagccctgtctgtaccttgctctgattcccgtgccattgctcaggttggtaccatctccgctaactccgatgaaaccgtgggtaaactgatcgcggaagccatggagaaagtgggtaaagaaggcgttatcaccgttgaagaaggcaccggcctgcaggacgaactggacgtggtagaaggtatgcagttcgaccgtggctacctgtccccgtatttcatcaacaagccggaaactggctccatcgaactggaaagcccgttcatcctgctggctgataaaaaaatctctaacatccgcgaaatgctgccagtactggaagccgttgcgaaagccggtaaaccactgctgatcatcgctgaagatgtggaaggcgaagcgctggcgaccctggtggttaacaccatgcgcggcatcgtgaaagtcgctgcggttaaagcaccgggcttcggcgaccgtcgtaaagctatgctgcaggatatcgctatcctgaccggcggtaccgtgatctctgaagagatcggtatggagctggaaaaagccaccctggaagacctgggtcaggctaaacgcgttgtgatcaacaaagacaccaccaccatcatcgatggcgtgggtgaagaagcgagcattcagggccgtgtttctcagatccgtcagcagatcgaagaagcgacctctgactacgatcgtgaaaaactgcaggagcgcgtagcgaaactggctggcggcgttgcggttatcaaagtcggtgctgctaccgaagttgaaatgaaagagaagaaagcccgggtagaagatgccctgcacgcaacccgtgctgcggttgaagaaggtgtggttgcaggcggtggcgttgcgctgatccgtgttgcttctaaactgagcgaactgcgtggccagaacgaagatcagaacgtcggtatcaaagttgcgctgcgcgcaatggaagcaccgctgcgtcagatcgtgctgaactgcggcgaagagccgtcagttgtggctaacactgttaaaggcggcgacggtaactacggttacaacgcagcaaccgaagaatacggcaacatgatcgacatgggtatcctggatccgactaaagtgacccgttctgctctgcagtacgcggcctctgttgccggtctgatgatcaccaccgagtgcatggtgaccgacctgccgaaagccgatggccctgatttaggcgctgctggcggtatgggcggcatgggtggtatgggcggcatgatgtaatcatgttgttctgcatcccgcagaaataagaaaacccccgggcagcaatgtccgggggtttttctttgcgcggcgtataacttctctaaatatatatcattattataatattggatttgtgattattaacagatgaacccataattccaggaacatattttgacaaacacagaaatgccaacaaaatgaatgtgctaactcattattttaaggatgttcttaaattaaagtgagtgctacggtaaattcatatattctgaaatgattcatattgtctataacattttatgttaatatacgcatccttcatgctaataaccttttgcagctaataatatgcgtttgcttatttataccactcgcaaatatattcaggagaagggatgcaatgaaaacgaattatctcgccatgtgcgtcgcgctggcgttgggcagcacggcgcacgcgaatgcgctttacgattataccagcggtaataacggcaacatttatgaatattacaatggtggcggatcggctgaaatgaaaatttcagggagtgtgacttatgatagccgcgtcgacaccgacgtcgacaataacaatataggtatctatttcggccggaacgttcccgattccgaagaacccggaatacttattatgaatgttgactcggcgaatattgaattagatgaaacccaaataggtatctacactgggggcgacgatggcggtggcgctatagtgaatgttaacgatagcgtaatgaatattaccagtgataacgattatgcggcaggtattgacatcgctgatgataaaattgcggagttacacattgataatactgcttctgatattacgctgacgggtactggtagcatcggtattactgcctacggctatcagtctttgacggtagatattgactctccggatttattcattaatgttggcgacgcgtctgcgggcaatagtattggcataaaagccgaggcattaggggcattcgcttcagagccagctaacacaaatatagctttggatgtgctggccaacatcaatgtgcagggctttaatgcaatcggtatgtccgcttatgcagcggaaggtcaaaataataatgtggcaattaacagttcaggggtaattactgcgcagggaacgggggcaaaaggtattcaggcccaagtctataacgatgttctcaacgacggtaatagcggtattaccattgacaccttagatctgcaattaaccgcttccggggaaggggcgcagggtattaacgcattcagtgaaaatagcggcgatattgttattaatcttgggggcaatacccagaccagcggcggttggggagcggatgccacgggcgtcagcgccaccagccagaaggccgtgacgatgagcatcgacgacaccgccacgctcggcgcgatgaatgacagcgcgatggttattaccgcgccgacggtgacggtcaacaacaagggcacgctcactggtaatctgaccctcagcggcgatgacgtcaccctgaataacagcggcaacctgcatttacgcaattggcaggatactgacggcgacggtacacgcgataccaaagccgtggcggtgtccagttttggcggcaacggggtatttaacaacaccggcacaatcgtgctcgacagcgtggcagacagcgacatcaccagcaccaacacctcaaaggaatatgccacgggttacagcgttaacagcaccagcaacgacggcattatgcaggcgcaactgctgggcctcagcacctttaccaacagcggcaccattgatatgagcgctaatgataaagcgggggatacgctcgttatcagcagcagcactgacgccggggttgccggtaacagtacgtatgtctccaatggcggcaccatcgccatggatgtggtgctcaacgaaggtggcgcgaattcgcagagcgatatgctgattgtcgataacgtcgaaatgggcagcgcgaaaaccgatctgctgtttaccaataccggcagcgacagcgatgcggcgttgaccaccggcgacggtattaaagtggtggatgtgcgcggcaacacgtcggaagatgcctttgaactggcggggcaaactcacaccatgagcgccgggcagtatatttatcgtctggagcagaataccgccgataccgactggtatctggtaagcgatgaggcaaatcctgaaccagcgccggatcctgagccgacgccggagcccgaacccacgcccgagccaacccccaatcctgatcccacccccgatccgacaccagatccggatcccgccccttcaccagacaatggtgatgacaatgggtcgatgatccgcccggaagtggccggttatctggcgaaccagacggcggcagtcgatatgatgatccagacataccacgatcgctatgatggacaacagccgggtggtgaaggcgcgcctgcgctctggggacgcattaccggcggccagtccagccacaacagcgctggcggccagttcgatgtcgatcaggaaagcgttcgcgtccagctgggcggcgatctcgtacgcctgaccagcaacggcagcgatgatatacgttttggcgtgatgggcagctggcagcgcagcgatgcagacagtgataaatactatcgcgtcagcgatggcgcaggaaaaacgcgctttaacatggacgcgagcgtggaaggttacagcgttggcctctatgggacatggctgagcgacgtgaaacagccggagcacttctatgtcgacagctggctgcagtacggctggtacgataacagcgtcagcagcaggcagtccggcgttggtgatgatgagtacgactccagcgtctggagcggttcgctggaagcgggttatggcgttgtgctgtcggaaaatgccgcgcagcaaagccaggtgatcctgcaaccacaggcgcagatcatttacagcgcctacgatgctgacagccacagcgacggcgcgggtatgtccgtcagcggctacgatgccgacggcgtaaccagtcgccttggggtgcgtctgtggcggcaaagcccgcagcaggtggtgcagccctttatggaaatcaactggtggcacggcacggcggataacagcctggaaattgataacacccgctatgacgatgatacgccagctgaccgctatgaaatgaagatgggcctgtccggcaatattacgccgggactgaaggcgtggggcagcctggcaatggctaccggcgataacagctatgacagctacggcggcatgattggcgtaaaatacagcttctgacgtgatatgaccgacaaacccccggacagaaatgcctgggggtttttcttttggtcatctttttagtataaggttcagacacggacaacgttgtccagctattacacgaggaataacatgcgcgtttacgtcggtgcagggattgtcggtgcagcgttgctgctggcgggttgtagcgccagcaacgatctgaccgctggtgggcaaagcgttcgttttgttgaagaaaaaccgagtgagcagtgtcgtttactgggcaccgcaaccggtacgcaaagcaactggttgtcgggtcagcatggcgaagagggtggctcaatgcgcggcgcggcaaatgccctgcgtaacgaagcggcaaaaatgggcggcaacgtgattttcaacgtcagcagcccgacccagggatttatgtcgagcttcgtgccgaccgccagcgaaatgagcggtcaggtgtataagtgcccgaactgatcgccggcatcttctaagatgaaccccgctccggggttcactgttttcaggccgccgatttctccacatgtaaccgcagattatgcaccgcatgcaggcactgcgcctgtgtcagcgtgaccttatttcccgccgccagtgttctgacaaataccttgcagggtgtgtgatccagcttgcgcaggcgattgctgaaacgcagcagacgtttaacgatgccctgggtttcttgtgacgcggaaggggatcgcgttttaatgaccgagccgctggtatgtatttctcctgcggtatttttatactgatagatcacgaccagatgatgggtgaacaggcggtatttccactcaggatgctgataagcgtcgtattccagctgcgcgttatcccggctgtcaacgtcatacagcggcaggaaatccagcacagaagacacgctttccaccagcgctcgtagcccggcattgttcattgcatgaataatcagtttcaccagcgccgggatttgcgtatccgcaatattcagggtcagcgtctcgcccgtattcagggtgaaggctatcgtcaggctgttgcctgtatcatcaagtagcgtaacgccttccacccgcaggcgcacatccgcatttctcagttcatcttcgaccagcgccggcgcgttgctgtgcagcgtgctgccagcgtcatcgggtacgcttttcacgggaagatgatattcaagacacagcagcagatctttcaggggtaacagcggaagaaacagcaggctgtcattattcgcctcgtgtttaattttcagggccagcgcagcaaaatcattgtcatgacgaataacgccagcgttcagtccatgaatagttaagggcatttatattctccatgaggggcggcaatataccggatgaagggcacagatttggcaagaaaacgcggggcagtataaggggagatgaggggtaaaaagagtccgaatgcggactcttaaagaaggcttattgctggcgcaattgcagatccagcggtgttttactcggctcgccgccgatttcacgcgccaggcgcggcaccatatagccggataccagggtcagcaattcacgcacgatctgacgcgcgtcctcgtcgctcaccataaaatgcgccgcgccctggactttatccagtacgtgcaggtaatagggcatcacacccgcatcaaacagggcattgctgagatccgccagcgtctgcgcgttgtcgttcacgccgcgcagcagcacgctctgattaagcagcgtgacgcccgcctgccgcagctgcgtcatggccgcgcggaaagcgtcgtcaatttcccgggcatggttgatatggttcaccagcaggatctgcaatgaggatcgcgccaggcgggccgccagcgtatcggtaatgcgcgccgggatcactaccggcaggcggctgtgaatgcgcagacgcttaatatgcgggatcgcctccagctcgccgatcagccagtccagctcatgatctttcgccatcagcggatcgccaccggaaaaaatgatctcatccagctccggatgcagcgcaatataatcgagcgcggcctgccagttgcgcttattgccctgattatcggcgtacgggaagtggcggcggaagcaatagcggcaatttaccgcgcagccgcccttaacaagcagcagcgcccggttacggtatttatgcagcaatcccggcaccacgctgtgctgttcttcgagcggatcggtggtaaagccgggggcggcgataaactcttcctgcgcggtaagtacctgacgcaacagcggatcgttcgggttgcctttttccatgcgcgccgcaaatgcgcgggggacgcgcagggcgaacagccgacgggcttcgcgtcccgcgagcagctctgcgctggcgtctatatttaaaagctgcagaagttcatcaggatcggttattacatcggcaagttgcaataaccattcttctctggaaggggtgtttagggttacaatgtgtgccattttttggctaataccagttaacaatatttcagagggccttatggcgacttactatagcaacgattttcgtgccggtcttaaaatcatgttcgaaggcgaaccttacgcggtggaatccagtgaattcgttaagccgggtaaaggtcaggcgttcgcacgcgttaagctgcgccgtctgctgaccggtactcgcgttgagaaaaccttcaaatccaccgattccgctgaaggcgctgacgttatcgatatgaacctgacttacctgtacaacgacggtgagttctggcacttcatgaacaacgaaaccttcgaacagctgtctgcggacgctaaagctatcggcgacagcgccaaatggctgctggatcaggctgaatgcatcgtgaccctgtggaacggtcagccgatcgcggtaactccgccgaacttcgttgaactggaaatcgtggaaaccgatccaggcctgaaaggcgataccgccggtaccggtggtaaacctgccaaactgagcacgggcgccgtggttaaagtgccgctgttcgtacagaccggcgaagtcatcaaagtggacacccgctctggcgaatacgtttcccgcgttaagtaattcctgccttatcttcagcggcgtggcgcaatgccaggccgctgacttcaaatcttcctaaaatatcgcctttttctccatagcccggaattttgtctatgcttaacaggctatacacaaataacactggctataaaaggaatatattatggttaagaaaacaattgctgcgatcttttcggtactggttctttcttctgtgttgaccgcgtgtaacaccacgcgtggcgtaggcgaagatatttctgatggcggcagcgcgatctctggtgcagccactaaagctcagcagtaacagcagcatacggtacggcctctgccgtaccgttgcttccgctttccggcagtgacaaaaacggcgtaaaacgattccccatgcccagcttcatgcggatatttcgtttataggtataaaccgttttgccattaataccgagccggtgagcgatacaatggttattagtgccgtccatccacagtgataatactttctcttcctgccgcgtcagcagcggtgtcaccgtctgattcacatcttctgtcggccgtgagcacagcgccccgttaatgctgcgagcaagtgcgtcaagcggtacagacttatctaatcgaccccagagcgggaactgctggcaatagctttccatctgcgcatcatgcccggacgataataacagcaacgggctttggctacagatgtgtaataacgaggctaattgctgcacgtgatgtaattcactcgcaaaaccatagagatcggcaatcaccagatccggctgccactgggcggcatgttctttggccagcattaaattgttcagcccggttaccagcaccggtcccggaaagatctcactttgattgagccagctctcaagcccgaagcgggtgaagcaacaacggtcaatcaataaaattttgaacatgtttggtttcgcagtcagaatgggtgacggctttcatttatctgaaagtacaccatcatagtgggaagacaaaaaagataaatgacggaactccgctgcgaactgcgcctatttcttgctttaagccgttaaaattttggataaataaaaaagttgaaatagtaaagtctggcggtaagaatacgcttctacataagccttgcaggacgacctgtaagcgccatcttcaacggggacggccccatctcaggagccaactatgtcctggttcgttttacttattgcgggtttacttgaagttgtctgggccatcggcctgaaatacacccatggtttcacccgtctcacgcccagtatcatcaccgtcagcgccatgatcgtcagtattgttatgctgtcgtgggcgatgaaaacgctgccggtcggcaccgcgtatgcgatctggacgggaattggcgcggtcggcgcgtccattaccggcatgatattgctgggtgaatccacaagcccggcgcgcatcatcagcctggtgctgattgtcgccgggatcatcgggttaaaactcagcacccattaacggttttgcgccacccagatgagtttctccaccgcaaagccctgttgttttgcggtgttcaccagatcctgtttcacgttatccggaatagtgcgggtgcgggacaggatccacaggtaatcgcgatccggcccgcagaccagcgcatggcgataatctttgtcgagcgcaatgacgttatagccgccgtaaaaagggccgaaaaacgacaccttcagcgccgcacggtttttagatcccgtaaagtaagcccggccatccgtcgattgccacataccccgcgacgggttatagcctttgttaataacgttcagcccgccgtcttcccgcaggctgtaggtggcggtgacgttatccagcccgcgctcaaaacggtgatccagacgggcgatttcataccaggtaccgagatagcgcgtggtattaaaattttccacgacggttacgccgggaggaggagtgggagactggcaggccaccatcagaagcgcggcggaaacgacggcaacgacaggcaatatacgcatggtattttccttccaggatttacagataagtgtaaagcgtcactggaattttgcccggcttgccgttgcgaagcgtgaccgggtctgcaacatcagacccggcactgtacttaaaggaaaattaccccgaccagcgtcaccacgctcaggatcgcggcaaggccgtagaacacccatttaccgtttggcacgtggatcttcaggtcgtgcatcaggtgatggatgcggtgcaggccgcaccacagcggcagcacaatcatcaggaagataaaggcgcgtccgatgaggctttgggcaaaggccagcacccgctcgaagctgagcgcgtcgccgggatacaaccccagcggcagcagcacgccgatcagcagcacgatgaccggcgcaaagaacgcgccccacatgccgcctgcgccaaacagcccccagaaaacaggttcgtcagagcgttgtggatttggattaatcattctggcctccttaccagtacagggcgacaaacagcaccaccagcgtcaccagcgccgtgacaacccacagccctttgatgatcggctgcggtcccattttctcgtctttgacgatgatattcgcggctttcggtgccaactcaaaccaggttttggtgtgcagcaacgcccccgccagcgtgatgaggttaaggatcaccaccaccgggttttgcaggaagcccacaaatcccgcccaactttctgcgccatgcttcagcgcaaacaggccataaatcagcacgatgctgaaccacacggtagtgattgccgtgccttcgcgcagcatataaaagcgataaaacggcaggtttttccaccagtttgacggcaccggccgcacgtaaggtttacgtttcgttgtcatcatgcgctccttagcgtggtttcagggtggcgataagaaagtctttcgaactttccactttcccctgctgaatggccgccgccggatcgacgtgcttcggacaaacgacagagcagtagcccacaaacgtacagctccagacgccgttctggctgttaagctgcgccatacgctctttcttgccgcgatcgcggctgtcttcgttataccggtgcgccagggtgatcgctgccgggccgataaattccgggttcagtccaaactgcggacaagcggcgtagcacagaccgcagttgatgcagccggagaactgatggtatttcgccatctgcgccggcgtctgggtgttcggcccctgatccggtgtacgcggattgccgataatgtagggtttaatggcttccaggctctcgataaagtgcgtcatatcgaccaccagatcgcgttcaatcgggaagttcgccagcgcctccaccttcatgccttgttcgtattcgcgcaggaaggttttacaggccagctttggcaccttgttgaccatcatgccgcaggagccgcaaatcgccatgcggcacgaccagcggtagctgagatccggcgcgaggttatccttgatatagcccagcgcgtccagcagcgaggtttgctcatcaaagggcacctcgtaaaacgcgctgtgaggggcgctgtccacttccgggttatagcgcaccacctcgattttcagggtttgtagctcagccattcgccttctccttcttctcggctgcttccgcttcgccgccgtacatgcgtttcgccggcggcagcgtggtgatcttcacgtcgctgtattccagacgcgtcgtgccgtcagcatcgcgataagcgagcgtatgtttgaggaagttgacgtcatcgcgttcggtgcagccttcgtccagacgctgatgcgcgccgcgcgactctttacgcgccatcgccgagtgcgccatacactccgccacgttcaggccatgcttcagctcaagggtatacagcagatcggtatttaacacactggaggtgtcggtgatgcgcacgcgtttgaagcgctcctgcaactccgccagcttatcgatggttttctgcatcagttccggcgtacggtagatgccgcagccttcttccatcgccatgcccatttcgtcgcgcagatgcgcccagttttcactgccttcctggttaacgagatctttcaggcgctgttccacatcaccggcctgggcgttcagcgccttatcgtcaggctgatgtgcgcccatggcatgttccatggctttttcaccggcgaggcggccaaagaccaccagttcggccagcgagttcgagccaagacggttcgcgccgtgcagcccgacagaggagcattcgcccaccgcgaacaggcctttgatgcgggtttcgcagttttgatcggtttcgatgccgcccatggtgtagtgcgcggtcgggcgtaccgggatcggatctttcaccggatcgacgccgacatacgctttggcaagctcacagataaacggcagacgttcgagcagctttttctcacccagatggcggagatccagatggatcacgtcgccgcgtggcgtcgaaatggtgttgcccttgcgccactcatgccagaaggcctgggagactttatcgcgcggccccagctccatatatttgtttttcggctcgccgaggggcgtttccgggcccatgccgtaatcctgcagataacggtaaccatctttattcaccaggataccgccttcgccacggcagccttcggtcatcagaatgccggaacccggcaggccggtcgggtggtactgtacaaactccatgtcgcgcagcgccacgccgtggttcagcgcaatgcccatgccgtcgccggtgacgatgccgccgttagtgttgaagcggtacacgcgcccggcaccgccggtggccatgatcaccgcattggcgcggatctgcaccagcgacccttccatcatattcatggcgacaaggccgcgcaccgcgccgtcatccaccagtacatcgaggacaaaatgctcgtcaaagcgctggatctgcggaaactgcaacgaggtctggaagagggtgtgcagcatgtggaagccggttttgtcggcggcaaaccaggtgcgctcaatcttcatgccgccgaagcgccgcacgttgacggaaccatccgggcggcggctccacgggcagccccactgttcaagctggatcatttcggtcgggcaatggtgcacgaaataatccaccacatcctgctcgcaaagccagtctccaccggcgacggtgtcgtgaaaatggtaatcgaagctgtcatgatcctgcgcgacggcggcagaccccccttcggcggccacggtatggctgcgcatggggtacacttttgagatcagggcgattttagcgttgggattcgcttgcgccgcggctatcgcggcacgtaatcccgcaccacctgcgccaattacggcaagatcggcttgaaaggtttgcacgacattcctccaggttttagttattccgcgtcgcccttaacaggcgtcgcaaaagcatgtccactgctccattatggggaggcagtataaccttgcgggaggaagggaaatttgatgcgttcgatttttttgccgatcttccgcgtgatttatcactctgtttgatggatccggccctttgtcttatttgtccgccgcgggcaataaattactgtgcaaaatttgtctctctggcgggttacgggtagacttcgtgcccttatcagcatacggagaattaccatgagcgagacggcaacctggcagccgagcgcgtccatccccaatttattgaaacgcgccgcgaagattgcggagatccgccgtttctttgccgaccgcggtgtactggaggtggaaacgccctgcatgagtcaggcgacggtgacggatattcatctgttcccgttcgaaacccgttttgtaggccccggccattctcaggggatgaacctctatctgatgaccagcccggaataccatatgaagcgtctgctggtggcgggctgcggtccggtgttccagctgtgtcgcagcttccgcaatgaagagatggggcgtcaccacaatccggaattcaccatgctggaatggtatcgtccgcattacgacatgtaccgcctgatgaatgaagtggacgatctgctgcaacaggtccttgagtgcccggcagcagaatccctgtcttatcagcaggctttccagcgccatcttgaaatcgatccgctctctgccgataagcaacagctgcgcgacgcggcggcgaagctggatctgagcaatattgcggacacggaagacgatcgcgacacgctgctgcaattgctgtttaccatgggcgtcgagccgcacattggtaaagatcgcccggcctttgtctatcacttcccggcaagccaggctgcgctggcgcaaatcagcactgaagatcaccgcgtggcggaacgctttgaggtctatttcaaagggcttgagctggcgaatggtttccacgagctgaccgacgcccgtgaacagcagcaacgctttgagcaggataaccgcaagcgcgccgcccgcggcctgccgcagcagcccattgatgtgaatctgctggaagcgctgaaagtaggaatgccggattgctccggcgtggcgctgggcgttgaccgcctgatcatgctggcactgggcgcggaaaacttaagtgaagtgatcgcctttaccgtcgacagagcgtaaggcttaacggtcccggccctctttctgaaaagagagccggggtgaggggattacaaacttcccgccgggcggccacgtccggcagaggtcagcgttctgtttgttgctttaccgcccagggtttccagacgcatctggaatggcgggaacggcatatcaataccgtgttcacggaagcccgccaggatcaactgatggatctcatggcgcagcggcatccggtgtcccatctccgcagcgtaaatacgcagttcaaacagctgaatgccctgctgtaaatccaccaggaacacttcgggcggcgggttatcgatcaccagcgagcagcgttccgcggcggtatatagcaactgcgtcacttcctcactattggcatccgccggagcaggcaccgtcagcaccacacgggttaccgaatccgacagcgaccagttgatgaactgctcggtgataaacgccttgttcggcacgatgatctctttgcgatcccagtcgctgatcgtcgtggcgcgggtattgattttggtgatgctgccggtcagatcgcggatcgttacggtatcgccgatgcggatgggtttttcgaacagaatgatcaggcccgagatgaagttggcgaaaatctcctgcaaaccaaacccgagcccgacaccgagcgcggccaccagccactgcaattttgaccactcaataccaatcatcgagaagcccaccagaccgccaaacagcatcagcagatatttggtgatggtggtaatggcgtagccggtgcccggcgtcagatcgaggtgctgcaacagcgccagctccagcagggcagggaggttacgcaccagctgcgtggtgatgataaacaccagaatcgcgatcagcaccgcgccaagggtaatcggctccagactttccacgccctgcacggtggaggtcacatcccacagggaaatattctccaggaagccaaacgcggagtggatttccgaccacagcacaatcaccgacagcagggcgatcagcatcaggatggagcgcaccaggcgcagcgactgggtactgatggtatccagatccacttcgctctcgtccacttccaccaggccttcggtgctggtggtgtgatgcggatcttcttcaccccgggcacgctgggcgaggatctcggcgcggcggtgtttagcgcgatcaaaggccagccgacgacgctggatcagcatccagcggcgaatgatgtgatacaccaccagcagcaggaaccagatggccaccgaggtctccagccgcgccagcagtgcctgcgctgtcgccagataaccgaccatagccgccagcatcgccaccagcggggcgctcagcagcaggttccacagcagatggttgcccatgttgtcactgctgccggttttgtcgacatacaacgggatcccggcgcgtttcaggctcagggtgaccatcgccagcgcgccgcaaatcagcataaagcacagtcgtccgagggagccggagaactcacggtcattaagattatcgaacatgatcagcgccataatcagcggcacgatcaggccaatacacagcaaatagttgcgcataccgcgcgccacacgcgcccgcggccacgcaaaatgcgcgacaaacagaccgttggggcgggcaaaggtggcgcaaatcatcaccgcccacagcatcggcacggtcgcggtgacgccatcgccaatcgccaccgccagcggatacggccaggcctcacgcaaaccataacccagggtagcccacagcaccggcagcggcgaggccaccagaatcgaccagaataccgtgcgcagcgtcagccagaagtgatcctgagtcaccttgccgacgcgggcggacgaacgctccagaaagcgggtaaagtgcttacgcgagtacaggctgaagccgacaaggaacagggcggcaaacagcggcagcagcgtttctttggtggtcagcatcatcagcgtggccttgcccagctggctgaaggtatccagcgagatcagacggcgcagatcctgcacgatatcgatcggccagctgagattgatagggctgacgtccgaggtccagaacaggtaacggtgcgtcgcctcgttcacctctttcagcgcgtcttccagctgcgtgtgcgacaccttgagcttggtgagttcaaggatcagcgtgtcgccgccctgcaacagcgaagtcagcagctcgcgctgagtacgcagttgggcgtcaagaatacggctttgttcgcgggtcagcggctgaccatcgacctgacggatctgccgcagttgcggctgcttgttcagcagatcttcatagcgcatacggtgcacgcgcagctgcgccatttcggtgtccagctgctgtggtttcggcatttccggcagacgggcgacctgcgcacgcagcgcttcgccaagcatgttggatgcccccagccactgggactgctcgcgcagggtattgagcgcctggcgtacctgtaacgtctgaccggtggcctgtcgttgctgagaggcgaccagatccatccgctgcgcctgctggttgagcgcctgggagagttcgcggttgattttaaactgatcgacaatgccgaccggcaggttggcgctgttttccgccagcatttcggtgctttccagcgcctgctcggcttcacgctgccgctggctgttgagctgattacgcagcgcctgtaagtaagtatccagctgcgccgcctgcttttgcgccagctcggagcgcatacgcgccagttcctggcggttgttggcggacagttgcgccagctccagttcatccaccagcgctttcagcctggcagattccgcctgagcactgagcagctgcgcctgggccagcgcggtggtaccggctggcgtaccggcgcggcgttccacctcattgagctggcggcgggcatcggtttgctgctgcggcagctggcttaaggaatcgctgatttcacgggcgcgctcctgctcctgctgcgccaggcgcgtcttatccagcagctggctgctgacctgcaaaatttcctgattgagggcgtcagaactcaggtcggtgggaatggcgcgcggctcgtcgcgcatactgttcagctgtgcgcgtaaggtctgggaggttttggcgaagtcgtcaatgacctgctgatactgctttgcgcgctcaagcgagccgttacgctcgtcgagcgcgttcagcgcggcctggagcacctcaacggtttcggcctgatccggggcgtttttcgcccctttagcctgctccagttcctgcgcgatttgtttagcgtcgggggccgtcgcagcggacgcccccatactgagactgaggcaccaggccatcagaaaagcgataatcaggcgcacatcagttaccttttaaaatcagacagggtctttcttgtcgtccaccagcgggttggcgtcgtgctcggcgtcgatctcttcctgcggcagcggggtcggctccggcatcacaatggcctcggtggagaccgccagcggttcgccgattttggttaccgacaggctttgcagctgttcaaccagttccactttgcccggcgcgaacaggttaatcaccgtagagccaagcttaaagcggcccatttcctggcctttcagcagggcgacagcgccatcgctttcacccgcgggccaggtccagcgtttgatgatgccttcgcgcggcggtgtgacggtgcccgcccagacggtttcgatgctgccaacgatagtcgcgccgaccaggatctgcgccatcgggccgaactcggtatcaaacaggcagatcacgcgctcgttacgggcaaataagtttggcacattgcgcgcggtcaggtggttgaccgagaaaagatcgcccggcacgtagatcatctcacgcagaataccgttacacggcatatggacgcggtgatagtcgcgcggcgacaggtaagtggtgacaaaggagccgttgcggaacagatccgccatcaggtaattcccggccagcagcgcttcaaggctgtagttatggccttttgcctgcaacagtttgtcgttttcgatgctgcccagttggctgatcacgccgtcggcaggcatcaccagcacgttcggatcggtattgagcggacgcacttcatcacgcagcgggcggacaaagaagtcgttaaaggtgcgatagctggcggtatccggcttttgcgcctcgttcatatcgaccttgtagtatttgacgaacagatcgataaccagtttggtcagccagcctgcgcgttttcttgcgccccagcccgcgaggcgagtcagccacagtttaggcagaatgtattgaagcgaaagtttaaatgagtctaacaaggtagcctccaggctaatattttttaccgttcccgatccgcgtattaccggcggatcttttaaaagggtgacaattctggcgatgcttagcttaaatgtcagctatcggtatcagaaaagtttttacgcgtttttacctgcgacatgctttccagaatgcgatgataattttcgaagcgtgattcggcgattttaccttgctcaaccgcctcgcggatagcgcatcccggatcggtatcgtgcttgcagtcgcgatatttgcagtggcctaaataatcgtggaagtcgataaagccccgggtaacctgctcaggctccagatgccacagaccgaactcacgtacgccaggagagtcaataacgtcgccgccgtgcgggaaatggtacaggcgtgaggcggtggtggtgtgctgaccaagaccggagttatcagagacgtcgttaacgaggatctccgtcggcaggcctaacagcgaattcagcaggctggatttgcccacgccagactgcccggcaaagatgctgatacgatcggtcagcgcctcttccagcggtttcaggccgtcctgggtgtagctggacaccatcagtacgcgataaccaatgtggcgatagatatccatctgctcattcacaaacgccatgccttctgcatccagcaggtcgattttattcagcacgatgatgggttcaacgtccagggtttcgcatgccaccaggtagcggtcgatgatgttaagcgacagctccggcaggatagccgagacgatgacaatctgattgatgttcgccgcgatgggttttaccccgtcgtaaaagtccgggcgcgtcagaacggaagtgcgctcatgcaccgcctcgacgatccctttcacgttaacgccttccgcggcggctttacccggacgccagacaacgcggtcgccagtgaccagcgaacgaatcgtgcgacgaatgttacagcggtgggtttcaccgtctgcggattccacgtcggcatgcatgccaaaacggctgattacgatgccttcagccgcttcgccaaacaggttgtcgtcaaggtccggtttctccacagacgtttttagccgccgctggtgattggcgttgacgcggcgctgctggcctttggagagtttatttttactcaatcgtgctgactcctggtcgcccctgatgggcaaaacctctatgatacacgctattttatactagttaaccagatgtggctggttatgcgagaagggtggaaaatagcatgagtgcaaatgaaaacaacctcatttggatcgatctggaaatgaccggcctcgatccagagcgcgatcgaatcatcgaaatcgcgacgctggtcaccgatgcgaacctgaacattctggcagaaggcccggttatcgccgtgcaccagtcagatgaacagctggcgctgatggatgactggaacgtgcgtacccataccggcagtggtctggtggatcgcgtgaaggccagcacccaggacgatcgcgccgcagagctggcgacgattgagttcctgaaacagtgggtgccggcaggcacatcgccgatttgcggtaacagtatcggccaggatcgccgtttcctgtttaaatacatgccggagctggaagcgtatttccattaccgctatctggacgtcagcaccctgaaagagctggctaagcgctggaagccggaggtgctggccggcctgaaaaagcaaaacacgcatcaggcgctggatgatatccgcgaatcggtcgcggaactggcctattaccgcgagcatttcatcaagctgtaacttttttttggcccctgtctttcgcaggcgaggggccataatgcggattttgatgggaaaataatcatcttgccgattaaagcagcacttgaacaaaaaatttaaatttttcagtttcagggcttgcagctaaaatgaattctcgtataatgcgcctcccgtaccgatgcagaaattgcaaagttacgcagagcgggaatagctcagttggtagagcacgaccttgccaaggtcggggtcgcgagttcgagtctcgtttcccgctccaaaatttgaaatggcttttaaagccgcgcagtatccagattcaaggatttcatgttgcaaccaggcagcctgaaagacgacgaatatgcgggaatagctcagttggtagagcacgaccttgccaaggtcggggtcgcgagttcgagtctcgtttcccgctccaaaatttgattggctttttacagccacgcaccacccaagcgggaatagctcagttggtagagcacgaccttgccaaggtcggggtcgcgagttcgagtctcgtttcccgctccaaatttcttctctgaataaattatccacagcgggatcccttgccgcagacgatttgtttcctctttgacatattcttgtgaacagacttatccacaggtttgttatttctgcctgtcccggtaaatgattcaggatgtgaatgaatttatgataactgcctgatatgtttcacaaaaatttcatttcaaaatgttaatcctgtcccttgacgaacttctccgccttgattagcaatgtttttttatttttatgcacaagctgtggaaaggtcaggcgtcgcgtttcagccctttttcgattacccgcaccagccgcaatttctgcggtaattgcacctcgacaacacaggcattccgcttatcaatttgctgcgcaatcgcccattctatgtgctcatcaagaagtgggtgctcacctctgcgctgttccagcgcgcgaatgttagcttcatcccagggcgcgttccccagcgcgacggcgatatttctcagccagcgtaaatgaccgatacggcggatcgccgatccttcggtgactttcaggaagtgggcttcgctccagccgaacagcgtaataagctcaggcgcgtgcagcgctttgcgcgggctgaagtcctcttcgtccgtcagttgcgagtagcggttccacgggcagatcaactgacagtcgtcgcagccgtagatgcggttgcccatcaaggggcgaaattcttccgggatcgcgccttccagctcaatcgtcaggtaagagatacagcggcgcgcgtcgacggtatagggctcgacaatcgcgccggtcggacagatggtcatgcaggccacgcatttaccgcagccttcttccaccggctgatcaaccggcagcggcaaatcgatcagcagctcgccaaggaagaaaaacgaaccggcttcgcgattaagaataagtgagtgcttacctgtccagccaagcccggctttttccgccagcgggcgttcaagaatgggcgcagaatccacaaagggtctaaaattcaacgatgcgcactgttcctggatcttttcaccgagcttttttaagcggttacgcaataacttatggtaatcgcggcccagcgcatagcgactgacatagcccagcgacgggtttttcagcgtgctggcgaaggcggcgttagcgggcaggtaattcatgcgcacgctgatcacgcgcagcgtaccgggtaaaagctcatgcggacgggcgcgcatcataccgtgacgcgccatccagtccatttcgccgtgatattgcttatccagccatgcctgcagtttgggttcggcggcggtgagatcggtgtcggtgataccgacctgctgaaagcccagttcagtgccccactgtttaatgttttgcgctaactgattgagatcgaggggctgtgacatgacggaccatacattgaagaaaaaccccgcaagtataccacactccatctggcctgcggatgaactcaaacgcgcggaacaggaggcggccgacagcctcggcatcacgctgtatgaactgatgcagcgcgctggtcaggcggcctttactgtcgcgcgggaacattaccccggggcgcagcactggctgatcctctgcggccacggtaacaacggcggcgatggctatgtggtggcgcgtctggccgccgctgcgggcattgaggtgacgctgctggcgcaggagagcgataaacccttgccggaggaggctcatgccgcgcgtgaggcctggcttgatgccgggggcgccattcatgcgccgacgctggcctggccggaaggtgtggaactgattatcgatggcctgctgggtaccgggctgaccgacgccccgcgggagcacatcgccgcgcttatcgaacatgcgaatcaacatcccgcgccggtgctggcgctggatatcccgtctggcctgctggcacaaacgggcgcgacgcctggcgcggtgatcaatgccgcgcataccctgacttttatcgcgcttaagcctggcctgctgaccggtaaggcgcgcgatgtggtagggcagctgcatcatcatgcgctgggactggaaagctggctggcgggtcaggaaactcatataacccgttttgatgccacacagctggcagactggttaccccccaggcggccgacctcgcataaaggcgataacggacggctggttatcgtcggcggcgatcacggtacggcgggggctatccgtatgaccggggaagccgcgctgcgtactggcgcagggctggttcgcgtactgacgcgcagcgaaaatatcggccctatcatcaccgcccgcccggaactgatggtgcatgaactcacggcgcaaagcctggatgaaagcctcgaatgggcggacgtggtggtcgtggggccgggtctcgggcaacaggcgtggggcaaagacgccctgcgtaaaattgagaattttcgcaaacccatgctgtgggacgctgacgcactgaaccttctggcaatcaatcccgataaacgtcacaatcgcatcctgacgccgcaccccggcgaagctgcacggctactgaactgtagcgttgcagaaattgaaagtgatcgcttactttcagcccgacgtctggtaaaacgttatgggggtgttgtggtgctgaaaggcgcgggcacggttatcgcctgcgagaacggcgagacgggcatcattgatgccggaaatgccgggatgggcagcggcggcatgggcgatgtgctctctggtattattggcgcgctcgcagggcaaaaattctccctgtacgatgccgcctgtgcaggctgcgtagcacatggcgccgctgccgacaggctcgcggcgcgttatggcacgcgcggcatgttagcgaccgatcttttttccacgcttcggcgtgtagttaacccggatgtgattgacgtaaaccatgattaatcgagtgatccctttacctgacgaagaagcaaccttagatcttggccagcgcgtggcgcaggcctgcgatggcgcgacggtcatctatctgtatggcgatctgggggcgggtaagaccacgttcagccggggctttttgcaggcgctcgggcataacggcaacgtgaaaagcccgacctatacgctggtcgagccttataccctcgacaaactgatggtctatcactttgacctgtaccggctcgccgatccggaagaactggaatttatgggtatccgcgactactttggccgcgacgcaatctgccttgtcgaatggccgcaacaaggcgcgggcgtgctgcctgaaccggatatcgaaatccatatgtcataccaggcacaagggcgtgaggcgtgcatttctgccgtttcctcatcgggtaattcgttactggcgcgactggccggttaactgtaggaatggcgggatgatcaatcgcgttaaaagctggttcgcgacaatactgctgctggcctgtacccaggcaggagcagcaaccttatccgatattcaggtgtccaatggcaatgatcaggcgcgcatcaccctgagctttatgggcgatccggaatacgccttttcccaggacagcaaacgcagcgtggcgctggacatcaaacagaccggcgtgatccaggggttgccgctgcaatttagcggtaataacctggtgaaggctatccgctctggtacgccgaaagataatcagtccctgcgcctggtggtcgacctgacgcagaacggtaaaacccgtgcggtgaagcagcaaaacggcgccagctataccgtggtctttaccattaatgccgatgcaccaccgccccctccgcctccgccgccggttgtggtgaagcgcgtcgagacgccagccgttgcgcccgctattgcgccgcgtccggcagagcctgcccgcaatccttttaaaaatgaaaacgaccgcgtaacgagcgtgaccagcagtaatacggtgacccgcccggccatgcgctcgcgcagcgcgtccggtgacaaagtgatcatcgccattgatgccggacacggcggccaggatccgggcgctatcggccccggcgggacgcgtgagaaaaacgtcaccatggcgattgcccgcaaactgcgcgcgttgcttaatgacgatccgatgtttaaaggcgtgctcacccgcgacggcgattactttatttcggtgatgggccgctccgacgtggcgcgtaaacagaacgcgaacttcctggtgtcgatccatgcggatgccgcgccgaaccgtgacgccaccggcgcgtccgtatgggtgctgtctaaccgtcgcgccaacagcgaaatggccagctggctggagcagcatgagaagcagtccgaactgctgggcggggcaggggatgtgctggcgaacagccagtccgatccctacctgagccaggcggtgctggatttgcagttcggtcattcccagcgtgtcgggtatgatgtcgccgtgaatatgctcggccagctacagcgcattggttcgctgcataaacgccgcccggaacatgccagcctcggcgtgctgcgctcgccggatattccatcggtgctggtggaaacgggctttatcagtaacaacagcgaagagcgcctgctgggcagcgatgactatcagcagcagctggcggaagccatttataacggtttgcgccagtacttccaggcgcatccgatccagtcggccccgcagggcggtgccggccagacggcgagtgccgcttcctcgggcggcgcgttctttaactaaggagatttcatgccgattcaggttttgccgccacagcttgcgaaccagatcgccgcaggcgaagtggtggaacgtcctgcgtcggttgtgaaagagctggtggaaaacagccttgatgccggggcgacccgcattgacattgatatcgaacgcggtggcgcgaagcttatccgcatccgcgataacggctgcggcatcaaaaaggatgagctggcgctggcgctggcgcgtcatgccaccagtaaaatcgcctccctcgacgatctggaagccattatcagccttggctttcgcggcgaggcgctggccagcatcagctcggtatcccgcctgacgctgacctcgcgcacagcagatcagcccgaagcctggcaggcttacgccgaagggcgcgacatggacgtaacggtcaaacccgccgcgcatccggtggggacgacgctggaagtgctggatctcttttataacacccccgcccgccgcaaatttatgcgtaccgagaagaccgaattcggacatatcgatgaggtgatccgccgtatcgcgctggcgcgttttgacgtcaccatcaacctgaaccacaacgggaagatggtgcgacagtatcgtgccgtcccaccaggcggacagaaagaacgccgtctcggcgcgatctgcggcgtgccttttatcgaacaggcgctgcaaatcgaatggcagcacggcgatctggggatgcgcggctgggtggcggatccgcagtccaccacctccgccttcgccgagatccagtactgctacgtcaatggtcgtatgatgcgcgatcgcctgatcaatcatgcgatccgccaggcctgtgaggataaactcggcgccgatcagcaaccggcgtttgtgctctatctcgagatcgatccgcatcaggtggacgtcaacgtccatccggccaagcatgaagtgcgtttccaccagtcgcggctggtacatgattttatctatcagggcgtattgagcgtcctgcaacaacggctggatacggcgctaccgctggccgacgcgccggaaccgcgcagtatgccggaaaaccgcatcgcggcgggtaaaaaccagttcgccagcccggcggtcgcccgcgagcctgcgccggagcgttataccgcaccggcggccgcgccgcgcgctggacagggtggcgggcaaagcagcggtggcgcaggctggccgaacgcccagccgggctatcagaaacagcagggggcgttatatcgccagttgctggagacgcccgccgttgagcgtagcgcgccagcccccgaacccacaccctccgccgttgacgcgcacagccagagctttggccgcgtgctgacgattatcggccaggattgcgccctgctggagcgcgacggggcgttattcctgctggcgttgccggtggcggagcgctggtacaaacaggcacagctgacgccgggtaatacagcggcctgcgcacagccgctcttgatcccggttcgcctgaaagtcagcgctgacgagcgcgcggcgctgcaacgtgcacaggcaatgctggccgacatgggcatcgaatttatgtccgatgcccatcatgtgaccattcgcgccgtgcctttacccttacgccaacaaaatttacaaatcttgattcctgaactgataggctacctggcgcagcaaacaacgttagacgcggcgaacaccgcccagtggattgcccgtaagcttgagagcgtccacccgcagtggagtgtggctcaggccatcacggtgatcgccgatgtcgaacgtctttgcccgcagctggtgaaaaccccgccgggtggcctggttcaacctgttgatttacattcggcgatgaacgccctgagacatgactgaccagagtatggcgagcctgcctaaggcaatttttttaatggggccaacagcctccggcaaaacggcgttagccattgagttgcgtaaagttttgccagtagagttgataagcgtcgattctgcccttatttatcagggaatggatatcggcaccgcaaagccggatgccgacgaattacgcgcggcgccgcaccggttgctggatattctcgacccggcgcaggcctattctgcggctgattttcgccgcgatgccctggcgcatatggcagagatcaccgccgccgggcgtattccgttactggtgggcggcaccatgctctattttaaggcgctgctggaagggttatctcccttgccgtcagcggatccggcggtaagagctaaaattgaacaacaggcggccgagctgggatgggacgcactgcacaggcaactgctggagatagatccggtggccggtgcgcgaattcatccaaatgatccgcaaaggctttcccgggcactggaagtttttttcatttcgggtaaaactttaacggaactgacgcaaacgtcaggagaggctctgccgtatcaggtgcatcagttcgccatcgccccggcgagccgtgaactgctccatcagcgaattgagcagcgttttcatcagatgttggcttcaggttttgaagcagaagtgcgggcgctttttgcccgtggagatttgcatacggacatgccttccattcgttgtgtgggataccgccagatgtggtcttaccttgaaggcgagatttcatatgatgaaatggtttatcgaggagtttgcgccacgaggcagttagcgaagcgtcagatcacctggctgcgtagctgggacggggttcactggttagacagcgaatcgcccgaacaggcaagagatgcggtattacaggtagttggtgctaacgcaaactgaatgtgtacaattacatcgtatcgtgcgcaaaattttacgcagttttcagggcctccgggttctaagtacaaaacaagcatataaggaaaagatagaatggctaaggggcaatcattacaagacccgtttttgaacgcactgcgtcgtgaacgtgttccggtttctatttatttggtgaatggtatcaagctgcaaggtcaaattgagtctttcgatcagttcgtgatcctgttgaaaaacacggtcagccagatggtctataagcacgcaatttctactgttgtcccgtctcgtccggtttctcatcacagcaacaacacgaccggcggctccagtaactatcatcatggcagtaacgcgcaggggtcctctgcgacgcaacaagacagcgacgacgccgagtaaggttagttgttgttaatccatgccggggagccagattatctgagttccccgctggtattttaagagggtttacgcttgtttgaccgttatgacgccggtgagcaggcggttctggtacacatctatttttcgcaagacaaagatatggaagatctccaggagtttgaatccctggtctcttcagctggtgtcgaagcaatgcaggtggttaccggtagccgtaaagcaccgcacccaaagtattttgttggtgaaggtaaggcagttgaaatagcggaagccgttaaggcaacaggggcatcggtcgtactttttgatcatgcgctgacccctgctcaggaacgtaatcttgaacggttatgcgaatgtcgtgttattgaccgcaccggcttgattttagacatttttgcccaacgtgcacgtacccatgaaggtaagttgcaggttgagctggcgcagctgcgccatatggctacgcgtctggtgcgtggctggacccaccttgagcgacagaaaggcgggattggtttgcgtggtccgggggaaacccagctcgagaccgaccgtcgtttactgcgcaatcgtattatgcagatcctctcgcggcttgaaaaagttgaaaagcagcgtgagcagggacgtcgctcccgtcagaaagccgatattccgaccgtatccttagtgggatacaccaacgccggcaaatcgacgctgtttaaccagatcaccgaggcccaggtttacgccgcagaccagctgtttgcgaccctggatccgacgctgcgccgtatcgacgtggcggacgtgggcgaaaccgtgcttgcggataccgtagggtttatccgccatttgccacatgacctggtggccgcgtttaaagccacgttgcaggaaacccgtcaggccacgctgctgttgcacgttgtcgacgcagcggatgtccgcttgcaggaaaatatcgccgcggtggatacggtgctcgaagaaatcgacgcgcacgaaatccccacgctgatggtcatgaataaaatcgatatgctcgacagcttcgagccgcgtatcgatcgtgacgatgaaaataaaccgattcgggtctggctttcagcccagaccggcgtcggtgtaccactgttattccaggcgttaaccgaacggctttccggagaagtcgcgcagcacacgttgcgtctgcctcccgaagaagggcgtttgcgaagccggtttcaccagcttcaggcgatagaaaaagagtggatggaggaagacggcagcgtgggtatgcagatacgcatgccgattattgactggcgtcgactctgtaaacaagaaccggcattggtggactacgtggtctaaccggcgtatcacctgaagacatttcccctctggggatatcaccgcataacaaatatggagcacaaacatggcgtggaatcagcccggtaataacggacaagaccgcgacccgtgggggagcagcaataagcccgacggtaactctgggggaaataaaggcggtcgcgaacaggggccgcctgatttagatgatattttccgtaagctgagcaaaaagcttggcggtctgggcggcggtaaaggtaccggttcaggcggcggaagttccgcgccaggccctcgcagtcatatgggaggacgtgtggtcggtatcgtcgctgcggccgccgtcattatctgggctgccagcggtttctataccattaaagaagccgagcgcggtgtggtcacccgtttcggtaaattcagccatctggtggagccgggtcttaactggaagccgacgtttattgataacgtgacggcggtaaacgtggaatccgtgcgtgaactggcggcttccggcgtgatgctgacgtccgacgaaaacgtagtgcgcgtggaaatgaacgtgcagtaccgcgtgaccgatccgcagcactatctgtttagcgtgaccagcgcagacgacagcctgcgtcaggccaccgacagcgccctgcgtggcgtgatcggcaaatacaccatggaccgtatcctcaccgaaggccgtaccgttattcgtagcgatacccaacgtgaactggaagagaccattcgtccgtacaacatgggtatcaccctgctggacgtcaacttccaggccgcgcgtccgccggaagccgtacaggccgcctttgatgatgcgattgccgcgcgtgaaaacgaacagcaatctatccgtgaagcggaagcttacgcgaacgaagtacagcctcgtgccaacggtcaggcccagcgtattcttgaagaagcccgcgcataccgcacgcagaccatcctggaagcccagggtgaagtggcgcgttttgccaaacttctgccggaatataaagccgcaccggaaattacccgtgaacgtctgtatatcgaaagcatggaaaaagtgctgagccacacccgcaaagtgctggttaacgataaaggcggcaacctgatggtgcttccactggaccaaatgctgaagggcggtaacgccagcggagcaaaaaatgagaccagcggtgccaacaatctgttgcgcctgccgcctgcctcaaactccggcagcaatgccagcaccgcaccgactgccagccagggtgacattatggaccaacgccgtgccaacgcgcagcgtaacgactcacagcgtcagggggaataacgatgcgtaagtctattattgcggtaattattatcgtgctggtcgtgctctatacgtctattttcgtggtgaaagaaggcgagcgcggcattaccatgcgtttcggtaaagtcctccgtgacgatgaaaacaaaccgctggtctttgagccgggtctgcatttcaaactgccgtttatcgaagccgtgaaaatgctcgacgcccgtatccagacgatggataaccaggctgaccgctttgtgactaaagagaagaaagacctgattgtcgactcttacatcaagtggcgcatcagcgacttcagccgttactacctggcaaccggtggtggcgatgtctctcaggcggaagtgctgctgaaacgtaagttctctgaccgtctgcgttctgaaatcggccgtcttgatgtgaaagacatcgtgactgactcccgcggtcgtctgacgctggaagtgcgcgatgccctgaactccggttctgccggcaccgaggatgaagtggccacgcctgctgccgatgacgaaatcgcgaaagccgcgaaacgcgttacggcggaaaccaacggtaaagtgccggtggtgaacccgaacagtatggcggccttaggtattgaagtggtcgacgtgcgtatcaagcagatcaacctgccgaacgaagtgtcggaagcgatttacaaccgtatgcgcgctgagcgtgaagcggttgcccgtcgccaccgttcacagggccaggaagaagccgagaagctgcgcgcggcctccgattacgaagtgactaaaacgctggcggaagcggagcgtgaaggtcgtatcctgcgtggtgaaggtgatgccgaagcggctaaactctttgccgacgcctttagccaggatcctgacttctacgccttcatccgtagcctgcgtgcttacgagaacagcttccagagcaaccaggacgttatggtgctcagcccggacagcgatttcttccgctacatgaagacgccgggcaacgccgtacgctaaccccggtcaggctgtttaatctgctaaaaaccaccgtgttcctcaggagccggtggttttctcattcagggacatttataaatgaacaccaccatctggctggcgctggccctcgttctggtgctggaaggcctcgggccgatgctttatcctcgtgcatggcgacgtatgatcggcgcgctcattcagcttcctgataacattttacggcgttttggcggcggtctagtggttgctggcgtcgttgtctactacatgttgaggaaaacgattggctgaagacaaagcacgccggtttgccgaaattaggcgacaaaaagtgctgattatcagaaaaagcgatggtagaatccttttttaagcaaacggtgattttgaaaaatgggtaacaacgtcgtcgtactgggcacccaatggggtgacgaaggtaaagggaagatcgtcgatctcctgactgaacgggctaaatttgttgtacgctaccagggcggtcacaacgcaggccatactctcgtaatcaacggtgaaaaaaccgttctccatcttattccatcaggtattctccgcgataacgtcaccagcatcattggtaacggcgtggtgctgtctcctgctgcgttaatgaaagagatgaaagaactggaagaccgcggtatcccggttcgcgagcgtctgctgctgtctgaagcctgcccgctgatcctcgattatcatgtggcgctggacgtagcgcgtgaaaaagcgcgcggcgcgaaagcgatcggcaccaccggtcgtggcatcggtccggcctatgaagataaagtagcccgtcgcggtctgcgcgttggcgacctgttcgacaaagacaccttcgctaccaaactcaaagaagtgctggaataccataacttccagctggttaacttctacaaagttgacgctgttgactaccagaaagtgctggacgatgtgatggcggttgccgacatcctcacttccatggtggtggacgtctccgatctgctcgaccaggcgcgtaaacgtggtgatttcatcatgttcgaaggcgcgcagggtacgctgctggatatcgaccacggtacctatccgtacgttacctcctccaacaccaccgccggtggcgtggcgacaggttccggtattggtccgcgctatgtggattacgtgcttggcatcatcaaagcttactccacccgcgttggcgcaggtccgttcccgacggagctgtttgacgacatcggcgagttcctgtgcaaacagggtaacgagttcggcgctaccaccggccgtcgccgtcgtaccggctggctggatgcggttgccgtgcgccgtgcggtgcagatcaactccctgtctggcttctgcctgaccaagctggacgtgttggatggcctgaaagaagtgaaaatctgtgtggcataccgtatgccggatggccgcgaagtgaccaccacgccgatggctgccgacgactgggaaggcatcgagccgatctacgaaaccatgccgggctggtcagaaaccaccttcggcgtgaaagagcgtagcggcctgccgcaggctgcgctgaactacattcagcgtatcgaagaattaacgggcgtaccgatcgatattatctctaccggtcctgaccgttctgaaaccatgatcctgcgcgatccgttcgacgcataatcacgccaggggcgccatcacagcgccccttgttttgcccttattacttcttcccatcaccgttcatttctaaataaattagcagcctgacaggtggctggtttatcatcaatagtgtcaatacaccacgggtgtcccgcgttttttcttatttcctgaggttgatgtgcagttaacgagtttcaccgattacggattgcgagccttaatctatatggcgtcgctgccggaaggacgaatgaccagtatttctgaagtgacagaagtgtacggtgtgtcccgtaatcacatggtcaaaatcatcaaccagctgagccgggcaggctacgtcacggccgtcaggggcaaaaacggcgggatccggctgggtaagccagcccgtgctatatgtataggtgatgtagtgcgtgaactggagccgctgacgctggtcaattgcagcagcgcattttgtcatatcacgcccgcctgccgcctgaaaaaggccctttcccaggccgtgcagagctttcttaaggagctggacagctacacgctggcagacctggttgaagagaatcaaccgctttataaattattgctggtggaatgacagacttttccgccagagctgacaacggaggaaccgcaatgtcacaagatcctttccaggaccgcgaagctgaaaagtacgccaaccctattcccagtcgtgaattcattctcgatcacttatccaaacgcgaaaaacccgctaaccgcgaagaactggcggttgaactcaatatcgaaggcgaagaacagcttgaagggctgcgtcgtcgcctgcgcgccatggagcgcgacgggcaactggtcttcacccgccgccagtgctatgcgctgccggagcgcctcgacctgctgaaaggcaaggtaatcggtcaccgcgacggcttcggcttcctgcgcgtggaaggccgtaaagacgatctctatctctcttctgaacagatgaaaatgtgcatgcacggcgatatcgtgctggcgcagccgctcggcgctgaccgtaaaggtcgccgcgaagcgcgtattgtgcgcgtgctggagccgcgtaccgggcagatcgtcggccgctacttcaccgatgccggtgtgggctttgtggtgccggatgacagccgcctgagcttcgacatccttgtgccgccggaagaagtcatgggcgcgcgcatgggcttcgtggtggtggttgaactcacccagcgtccgacccgccgcaccaaagccattggtaaaattgttgaagtgctgggcgataacatgggcaccagcatggctgtcgacatggcgctgcgcacccacgaaatcccttacgtctggccgaaagcggtggaagacgagatcgccagcctcagcgaacaggtgccggaagcggcgaaatcaggccgcgttgacctgcgtaacctgccgctggtcaccatcgacggcgaagacgcccgtgacttcgacgatgcggtttactgcgagaaaaaacgcggtggcggctggcgtctttgggtggccattgccgacgtcagctactacgtgcgccctggcaccgcgctggacgacgaagcgcacaaccgcggcacctcggtctacttcccgtcgcaggtggtgcctatgctgccggaagtgctctccaacggcctgtgctcgctcaacccgcaggttgaccgcctctgtatggtctgcgagatgaccatctccaccaaagggcgcttaaccggctacaaattctatgaagcggtgatgagctcccacgcgcgtctgacctacaccaaggtctggcatatgctggaaggcgatcaggagctgcgtcagcagtacgctccgctggtcaaacacatcgaagagctgcacaacctctacaaaaccctgaaccaggcgcgcgaagagcgtggcggcatctctttcgagagcgaagaagccaagttcatcttcaacgcggaacgccgtattgagcgcatcgagctgactgagcgtaacgacgcccacaagctgatcgaagagtgcatgatcctcgccaacatctcggcggcgcgttttgtcgagaaagcgaaagaaccggcgctgttccgtattcacgatcgtccgactaacgaagccatcacctccttccgctcggtactggctgagctgggcctggagctgccgggcggcagtaagccggagccgggcgattacgcggcgctgctggaatccatcgccgatcgtcccgatcatgaaatgctgcaaaccatgctgctgcgctccatgaaacaggcgatttacgatccggaaaaccgcggtcactttggtctggcgctgcaacagtatgcgcactttacctcgccgatccgtcgttatcctgacctctcgctgcaccgcgccatcaaatacctgctggcgaaagagcaggggcacgaaggcgacagcaccgaaaccggcggctggcactacagcgtggaagcgatgctgcaactcggtcagcactgttctatggccgaacgtcgcgccgatgaagccacgcgtgacgtcgccgactggctgaagtgcgactttatgcaggatcaggtgggcaacaccttctccggggtgattgccagcgtcaccggctttggtttcttcgtgcgtctgaacgagctgttcatcgacggtctggtgcacgtgtcgtccctcgacaacgactactaccgtttcgaccaggttggtcagcgtctgatcggcgaatccggcggccagacctatcgcctgggcgaccgcgtggaagtacgtgtggaagcggtcagcatggacgagcgtaaaatcgacttcacgctgatttccagcgaacgcgcgccgcgtaacgtcggcaaaaccgaacgcgaaaaagccaaaaaaggcgcgccgggacgtaacgtcagccgtcgtcgtcaggtgggcaaaaaagtgaacttcgagccggatagcgcattccgtggcgaaaaaggcaaatcaaaagccaaagccaaaaacccggacagcgcgcagccgaaagcgaagaaagagaaaaagccaaaggcgccttctgcgaaaacgcaaaaaatcgcagcggcgaccaaagccaagcgcgcagcgaaaaagaaagtcgctgaataacgcagcctctgcacaataaataaaagcctcttataataaggggcttttttttattttcgcggttagttaattttcagcaatagatatttattatttgtcattaggctcaaagcccggcggtgtagagtagctcaataattattattttgctgatgagcaaattctcaaggagctactatgcatctggcccgttttccgcgcctctcgttaggtcatttccccacgccgctcgaacctttagataatctgagtaaattactgggcggaccgaaaatatggatcaagcgcgatgacgccaccggacttgccaccgggggaaataaaacccgcaaactggaatttttgctcgccgacgcgctgcaaaaaaacgccgatgtgattattacccagggcgcaacccagtcgaatcacgtgcgtcagactattgccggcgcggcaaaattaggcttacaggcgaaagtgctgctcgaaaagcgcgtcaccgatttcggcgaagattaccagcgatccggtaacgttttgcttgatgaactgctcggcggcgagatagtcgcccatctgccgggcggcaccgacatgcagcaggcgatggacgactatgccgccacgctgcgcgaacagggctttaacccttatgtcatccccggcggcggctctaaccccataggcgcgctgggctacgtggcctgtgccgaagagctgctttaccagtcctcccaattacgcttacgcatcgatcacgtggtgcacgccaccggcagcaccggcacccaggcgggccttgtcgccgggtttactgcgaccaatagccatgtgcccgtgctcggcatcagcgtgcgcgcgccgaaagagaagcaggaagagaacgtatggaacctggcctcccgcacccttgcgctgctgggtgtggcgggcgagctgccgcgtaaccgggtggttgccaacagcgattacgtgggcgacggctacggtttacctactgacggcatgacagaagcgctgcgcctgctggcacgtcacgaaggcattctgctggatccggtctattccgggaaaggctttgccgggctggtggatctgatccgcaacggtcatttccgtcaggacgaaaacgtggtctttatccacaccggcggttcggcgggtctgtttggttatcgtcaggtgctggaaaaatgacacccttcctgctcggcgtgctgggcggcatggggccgctggcgacggtggattttatggcaaagctgctggaggccacgcctgcgcagcgcgatcagcagcagatcccggtgctggcgtggaacgtgccgcagatcgccgaccggcaacaggcgctggcgggcacaggcccgtcgcccttgccacagttgctcaacggtatcaaaacgttaaacgccgcaggggcgagccacatcgccatcccctgtaacaccgcccatcactggtttgcggcgttgcaggcggcaagcgccgcgccgctggtgcatatcgttgaggccaccctcacgcagatccgccctgagcacgccacgcgcgttggggtgatcgccaccaaaggcacgctcgacgcaggctggtatcagcaggggctgcgccgtctgggcatcacgccggtgctgcccgacactcatgagctggaaaagctgtttgtaccgggctgctacgcggttaaacgcggtgcgctgcgtgaaggcggcgagttactggcgcgccaggcgcaggcgctggttgaacgcggggcgcagcaattaatcctcgcctgcaccgaagtgccggtcgccctgaaggccattgactccccctttctttcccacgccgtcgatccggcgcaggcgctggcggagcgctgttccgccctctggcaggattatcgccattcctgttgtgaataaatgcttagcaataatccgtataaataaatcaacgccggctgaatatactggtcgggcgctaaataattaatttcctcacaggataataaaatgaaaaaaagtctctgcttattactggcagcgggtagcttatggtcgcagatttcttttgccgccacgccggaagaagtccgtattgcttatagcggcggttcgcaggtattaatgctggcaaaagccgatggttcgcttgataaagcgttaaacagcaaagtgaaatgggtgcaatttgcttccggagccgatgcattaacctatttcgccagtaatgctattgatattgccaattttggctccagcccggcgacggcgggtattgtgcgtaaattaccggtggaaataatcggcgtgtccggcgtgatcgccagctacgaacgcttaatcggcaaagagggcatcacccgcattaatgatattgaaggcaaacgtgtgggctatccgccaaactccaccgcgcaatatgcgctggaggcggcgatcagcgtcaacaaactcgaccgcagtaaaattaccctgttgccattgcgtccggcggaaatggttgccgcatggaagcggggcgatattgacgcgggctacgtctgggcgcccttcgcccaggagctggagtcagctggcgggcaccaggtgttcgccaccaaagatctgcaacaggcgggctacctgatctacaacaactatgtggtgcgtaaagcctttgccgaacagtacccggaggtggtcagcgccttcctgcgcgtgcatcaggaaaaggtcaatgagttcaaaaaagatcctgaacgtgccgccgccatcgtggcgaaagaagtgggcgcgcctgtgaccaccgccgccaatacgctgggcggtctggaatacccgacgctgagcgaacagggcaccgccgcctggctgggcgacggtacgcacagcaccgacagcggcatcggcaaagcgctgaccaaaacctcaaacttcctcgccggaattggcgagatccgcaagcgtgacatccccgcgaactgggacgcggccatcaactcccgttaccttcgcgatgcggcggtgaacgcaaaatgagagtaagtcagcacatcgccatcagcgtgctgtcggtggcgatcttttttatcctctggcaggtggcggcgacccggcaatgggtggatccgctgctgctgccgtcgctgacggacatcggtctgaccacggaagagctgctcgctgacggttaccggcaggttccgctctggcagcatatcgtcgtcagtctcgcgcgggcgctcagcgcctttgcggtggcgattgtgatcggtattccgctcggcctgttgatgggcctgtccgacgggctggcggcagtgcttaaccccttcgtgcagtttctgcgtccgctgccgaaaatcgcgctgatcccgctggcggtggtatggctcggcatcggtgaaagctcgaaattctttctgattttcatcgccaccttcctcagcgtggtggtgggggccagcgcggcggtggagcgcattggtcgctcgcgcattcgcgtggcgcagaccctcggcgcttcccgacaacaaattttcctgcgcgtggtgttgccggacgcgctgccggatctgtttaccaccgtcaggctgtcgattggcattggctggacgtcgctgatcgccgccgaaatggtcgccgccagctctggtctgggctggatggtgatcaacgccagctcttacttacgcaccgatatcgtcatgctgggcatcctgctgctcggcggcattggctatctccttgatttacttatcctcggcctgcaacgcgtgtttgtgccctgggcaggaaaagaataatgactatacagattgcgctggagcaggtgtccctgcaatttgcggcgaaaccgcatccctttaccgtgctggaagacgtctccctgtcgcttgcgaagggcgaatttgtggtgctgttggggccgtcgggctgcggcaaatccaccattcttaatcttgtggccggctttacccggcctgaccgcgggcgggttctgagcggcggcgagccggtacgcaagcccgggccttcccgcgggatgattttccagcagccgaatctgttcccctggctgtcggtgctggataacgtcacctttggcccgcgcctcggcagccaccgcaaagacgacgtgaacgcgaaggcgctggactggctggcccgcgtcgggctgaaaggctttgaacatcacgccccctggcagttgtcgggcggcatgaaacagcgcgtggcgctggcgcgcgcctggctgccggaaccggaagtgctgctgcttgacgagccgtttggcgcgcttgacgcccagacgcgcctgatgatgcaggaattgctgcgcaacgcctggctggaaacggacaccacgctgctgtttgtcacccacgacgtggaagaagcgctgttcctcgccgatcgcatcctgatcatgtcggcaaaacccggcaagatcgtggaagaaattgtcagtcccttcggtcgcgagcgcgacattgaatccctggtggaacacccgcgctacggcgaaatcaagcatcacgttctgcatcgcgtccgtcaggaggcaaagcgtcatctgagttaaccccttcatcaaccgacatcacaaaaaggtggaagcaatgagcattagcgagttaaccgcacgactggaacagagccttaatcaacaccgcgacgagtacatcgccatctcaaaagatattcatgcgcacccggaaaccggtaacaatgaatattacgccagcggcctgctgacggcgctgctggcgaaaaatggctttaccgtcacggccaacgtcgccggtcacgaaaccgccttctatgcggtaaaagagagcggcaggccagggccgaccattgcttatctcgccgaatttgatgcgctgatcgatatcggccacgcctgtggacataacatcatcggcgtttccagcatcgccgccgccattgccctgagccagacgctggataaaaccggcggcaaagtcgtggtgctgggcacgcctgcggaagagggcgggctgcggggtaaaggtggaccgaatggcaacgtgaaagcccgctttgttgagcacggattcctgcgggatgtagacgcggcgatgatggtgcatccgggtggcagaacgcgtctgaccgggccgttccttgccaataaccatctctacttccacttttatggaaaaccctcccatgcgggcagctcgccgcacaaaggggtcaacgcgctggacgcgctggtgctgctctataacggcatcagcgtgctgcgccagcaactgccggacggcgtgcgcgtccatggcatcatcactaatggcggccaggcgccgaacgtgatccctgaatacgcctcggcgcatttttatatccgcgcggaaagccgtgaggccgttgaagcgctggagccacgcatccgggcgattgccgagggcgctgcgctggcgaccggcgcgacggtaaaaattgaacatcaggtcggcccgcgggatttcaacatcaatgacacgctgaataacctgtttcttgaagagttcacggcagtgggcgaaccggtcgatctcagcgccaaagagggcaaaggatcgacggacgtcggcgacatcagccatgcagtgcccactgcgcatccgtccatcaagattggcccggacgatttgatcggccacacggtcgccttccgcgaagccgccaactctgaaaaagggtacgaagccttaatcaccggggcgctggtgctggcgcgcgccgggctgcggctgctcaccgagcctgcgctgcttcaggcggcgaaggatgaatttgccggacgacctaccacctcaaacgcggcctgatcgccaccggagccagaaaaacaatgaaaatgacattctctgccgccgcactgctgctggcggcggctttaccctggggaagcgcactggccgaagccgtgaaccgtaatgcgacgctgaacatcgcctatggtaaccggcccggcactctcgatccgtatctcaccaccaataacgccacctctgatgtggatcgccatatctttgaagagctgttcaccatcaacgataagtttgagccggtgccggatctggtggcgtcctatacgctgagtgacgatcgcaaaacctacaccttcgtgctgcgcgacgacgtgaagttccacgatggtcagccgctcaccgccgatgacgtggtggcttccatgacgcgctggctggcggtatcgacgcagggtaaagctaacctgccgggggcgcagttcagcaaggtggacgacaaaaccgtgcgcctcacgctgccggagccttcgctaatcgcccttaacgtgctggcggacgtgaaaaacatcgccgccatcatgcccaaacgcctgatcgaccaggccaacagcagcaaaaaaccggtcaccgagcttatcggtaccgggccatacaaactcgcggagtttaaacagggcgagtatttacatctgacgcgctatgacggctttgtgtcgcgcaaagagccgtccagcggactttccggcgctaagccagccaacgtaaaagacatctggttccgctatatcaccgatgaatccacgcggctggccggagcgatgaccggcgaatacgacattgtgtttaacctgccgaaagacaatatcgatgcccttaccaacgcgccggatctgagcctggcgcggcccgaaagcggcggttcgctgatcacctatctgttcaacaaacagcaagggccgttcgctgacctaaagcttagacaggcgtttaacctcgcgctcgacgtgcaccagacgctgctggcgggctacagcgatccgcgtttctttaaagaagatccgtcgctgggattcccgaatcaggtggactggtacagcgaggcgggcaagccattctggaaccagcataaactcgaggaggctcgcaaactggttaaagaatccggttataagggcgaagaagtggtgattatcgccaccaaagagtatgcagagctgtataacctggcgattgtcgcccagcaggtgctgaaacagatcggcgtcaaatcccggctggacgtctacgactggccgacggtactgcaacgccgtcaggatccgaagaacttcgatctgtgtgcgctggagttctccatgcgtcaggtgctgcaccagtatcccttcctcgactcccgggcgaagtttccgggtctgagcaacagtcaggaaatcgatgcggcgcttgatggcatcaagcaggcggcatcgctgaaagaagcgcggccactggtggataaactgaacgtgctgacctggcagtatctgccggttatcgtgcttggtcataccacgcctgagccggtcgccctgaagaaaaacgtgcacggctaccatgatctgattgggccggtgctgtggaatgttaccgtcacgccgtaaccggagacgtctatgaagtggttcttgtttcaccggctgatggcgctgctgcccgtgctgctggtggtatcgctggtggtgttttgcctggtgcatcttgcgccgggcgatccggtgctggtgatcctcggcaatgacgccagcccgcaggacattgccgcgctgcgccagcagatggggctggatcagccgctgctgatgcaatttgtgcgctgggcgggggcggtgttgtccggcgatctgggccactcgctgtttctcaatgccagcgtcagcgagctgtttttacagcatctcaccccgacgctggcccttgcactgtacgcgcagctgattgcgctggtgctggggctggggagcggggcgatcagcgcctggcagcatggcggcatggccgaccggatcattcgcgcgctggctaccttcggcatgtcggtaccgggctttctgctcggcctgttcctgatcttctttttcgccgtgcagctgcgctggtttccggtggtgggctatcgctccaccaacgaaaacggtctgcaaaatctctggtatctgacgctgcccgccattgcgctcggttttcgtattgccgcgctgatctcacgcatgacccgcgcggtaatgctcgacgtgctgcaggagaattttattcataccgcccgcgccaaaggcgtgcccgagcgcatggtgctgctgcgccatacgctgaaaaacgccctgatcccggtgctgaccatctgcggggaatccttcgcctcgctggtcaccggcaccatcgtcatcgaaagcgtattcggcattcccggcgtcggctcgctggtggtggactccatcgagcggcgggatttcacggtgatccagggcgtggtgctgctgatcaccgtctgttacgtgctgattaatctggcggtggacgtgctcagctatatggtcgatccacgcctgtccgtcgaggggagtgaaagcgcatgacgcgaaacaaactctggctatggtgcggcgtgctggcgggcattgtgctgctctcggtgtgcggcacctttttcagcccttacgatccttatgctatcgatccgctcagccgcctgaaggcccccggcgcggcgcactggtttggcaccgataactttggccgcgatctgtttgtgcgcgtggcgctggcggtgcgggtatcgttttccgtcggggcggcggtggcggtaatagccggggcgatcggcatgctgaccgggctgctctgcgcctggtatcgcccggtggatcgcattctgatgcgcgtctgcgacgggctgttcgcctttccgtcgttgctgctggctatcgctattgtcggcgtgctggggccgaacatcgctaacgttgtgctggcgctgtcgctggtatacgtgccgtccattgcgcgggtgatccgcggcgcagcgctggttatcaaagagaaaaatttcattgaagccctgcgcgcgcagggagcctccccggcgcgcattatctggctacatctgctgccgaacgtgctgtcgccgctgattgtgcaggtcacctgggtgttctcagtggctattctgaccgaggccgcgctgagctttttaggatccggcgtgcctgcgcccacgcccagcctcggcaatctgctgctggagggaaaagcagtgatctttaccgcctggtggatgaccttttttcccggcatcgccattgtgctgctgatcctcgcgctgaatattatcggcgacgacctgcgcgacagcgccgagccggggctgaaaccgctgccgcagcgtgtcctgcgcctgctgaaaaaaggggagcaacatggttaatccgccgccgctgttaagcgtcaaagatttgcgggtgaatttcgccacgccgcagggcgtggtggccccggtgcgcggcgtctcctttaccgttcatcatcatgaaacgctgggcatcatcggtgaatccggttgcgggaaaagcgtcaccgcgcaggcgctgatggggctattgtccccgcgcaccagccgcactgaaggtgaaatcgccctcggcggtcaacgcctcgacacgctcccggcaacggcacgtcgtcggcgctgcggcggcgagatggcgatgattttccaggatccgctctccagcctgaacccggtgctgactatcggctttcagattgaagaaagcctgaagctgcataccgcgttaaaccgggcgcagcgccagcaaaaacggctgcgcctgctggagcaggtgggcattgctgatgccgcccgctgcgtcaacgcctggccccatgagctttccggcggcatgcgccagcgggtgatgatcgccatggcgatcgccagtgctccgtcgctgctgattgccgatgagccgaccaccgcgctggacgccactatccaggcgcaaatcctgcaactgctggacgacatcaaacagcagagcggaatggggatcatctttattacccacgacctgagcgtggtggcgcggctgtgtcagcgcgtggtggtgctctacgccgggcaggtggtggaggaaacggacgtgatgacgctgttcgaaaatccccgccatccctatacccgcgcgctgctggcggcgcggccctcgctgtcccacacgccgaagacgcggctggaggagatccgcggcagcgtcccggcgctggatgcgctgccgggcggctgtacctttgccgatcgctgtccgctggcgaccgccacctgtcgcgcacagccgccgcagctgcgcccgctcggcggtcacggtcatcaggtgcgctgctggcgcgcagaagaaacgggagtcatgccatgaataagccgttgctgaacgtacagcatctgtccaaaacctttacccgccgcgggcacagcgtgcaggcggtgcaggacgtcagttttaacatccatgccggggaaacctacgcgctggtcggcgaatccggcagcggtaaaagcaccatcgggcgcactcttctcggtttaaccccggcctccggcgggcgggtggatttcaacggccagtcgctgctggatctcagcgccgccggatggcgcagcgtgcgcaaagacattcagatgatcttccaggatccgctctccacgctcgatccaaagcgcaccattggctacagcattgaggaaccattgatcattcacggcgaacgcgatgcgcagcgtcgtaaaaaagcggtggcggcgatgctggaacaggtcggtctgcgggcgcaggatgccggacgttatccgcaggcgttttcaggcggacagcgccagcgtatcggcatcgcgcgggcgctgatcctgcgtccgaagctgatcatctgcgatgaaccggtgtcggcgctggacgtttccattcagtcacaggtgctgaatctgctgatggatttgcagcgcgactatggcctcgcctacctgtttatctctcacgatctcaatgtggtgcgtcacgtggcggatcgggttggcgtgatgtatcgcggacaactggtggaagaggcgaccagcgcgcagctttttgcccatccgcagcatgactacacgcgctggctgctgtcggcgatactgcctgcgcatcccgcagaaaaaaaccggcttcctgcggcggtgaatgcgtaacggggaaggacgtccgggggcgtcgtgggttataatgggcgggaaacacccttttaacctctactgagtacccttcatgagtgaaatgatttatggcatccacgcggtgcaggcactgctggaacgcgcccctgagcgctttcaggaagtttttattctgaaaggacgcgaagataagcgcctgatgccgctgatccatgcgctggaagcgcagggcgttccggttcaggtggcctcccgtcagtttctggacgagaaaagcgaaggcgcggtacaccaggggatcattgcgcgcgtgaagccgggtcgtcagtatcaggaaaacgatctgccggatctgatcgcaagcctggataagccattcttcctgatccttgatggcgtcaccgatccgcacaacctcggggcctgcctgcgcagcgccgatgcggcgggcgtccatgcggtgatcgtgccgaaagaccgctctgcgcagctgaacgcgacggcgaaaaaagtcgcctgtggcgcagcagaaaacgtgccgctgatccgcgtcaccaacctggcgcgcaccatgcgcgtattgcaggaagagaatatctggatcgtcggcacggcgggcgaagcggaccacaccctgttccagagcaaaatgaccggcgcgatggcgctggtgatgggcgcggagggcgaaggtatgcgccgtctgacccgcgagcattgcgatgagctgatcagcatcccgatggcgggcagcgtctcctcgctgaacgtgtcggtggcgaccggcatctgcctgttcgaagcggtacgccagcgcggttaactgtctgcgaacaataaaaagggccatcagatgatggcccttttttctggctgtaaaacggcttacggccttctgaacagcgcgatactgcggccttccagttcgaattccttctctttggtaatgatcagcccgcgtttggcggtatcggacgtggtcagctccagcatccagccctcatccgtggactgcgggatcaggaagggcacgttaccttcgaacgggttaaacagcaccagcacttcgtgccacaggccttcttcatcatgcaaatcgtggcgggtcagtgaaacgcccagcgtcgagccttcatcccactgctccggctgctgatagccgccaccggcgttgaaccacttgatctccgtgccgtcgcgccagctttcacggcgcaacagcggctgcttcgcgcgcattttgatcagatgacgggtgaactcgcgcagcgcctcactgctttccggcaggttatcccagtgaacccaggaaatctcgctgtcctggcagtagccgttattgttacccatctgactgcggccaaactcatcccctgccagcagcattggcgaaccgtgggacaggaacagcgtggtgaggaagttacgcttctgccgttcacgcacgttgttgatgccttcgtcgtccgtcgggccttccgcgccatagttataggagcggttatcgttatggccgtcgttattgtcttcgccgttatcgtcgttgtgcttctcgttataggacaccagatcgttcagcgtgaagccgtcgtgggcggtgataaagttgacgctcgaccacggacggcggccgcgcagatcgtaaatatcgccggagcctaacagacgcgcggcaaagtcggtggagacattgacgcctttccagtattcacgcaccgtatcgcggtatttatcgttccattccgcccagcccggcgggaagccgcccacctgatagccgcccggtccgatatcccagggctcgccgatcagcttcagtttcgacagcaccggatcctgcataatggcatcaaagaagccgccgcgctggtcaaaaccttccggttcacgaccgagaatggtgcctaagtcgaagcgaaaaccgtcgatatgcatcgattctgcccagtaacgcagggaatccatgatcatctgcaatacgcgcggatgcgaggtgttgacggtgttgccggtgccggtatcgttgatgtaataacgatgctgatccggcatggtgcggtagtaagagaagttgtcgatgcccttaaaggagagcgtcgggccgagttcattaccctctgccgtatggttgtacaccacgtcgaggatcacttcgatgcccgcatcgtggtacgcgcgcaccatgtcgcggaaaccctgaatgccgttagggccgaaatagcgcgaagccggcgcgaagaaaccgagggtgttatagccccagaagttcttcagccccttatccagcagatgctgatcgtccgggaaccagtgcaccggcagcagttccaccgaggtcacgcccaggctcttgatgtactccaccgtcgccggatggcccatgccttcataggtaccgcgcagttcttccggaatggcggaattgagctgcgtaaagcccttcacatgggtttcatagagcaccgtttgcgaccacggaatgtttggacggttttcatctttccagtcgaattcattgggatcgatgacgcggcattttggcgtaaagggcgcgctgtcctgggtatcaaaggtcagatctttatcttcgtgcagcagctcgtaggcgaaatgcgcgtcattccactcgatgtcccccgccagctcacgggcatagggatcgagcagcagcttgttggggttaaaacgatggccgttttccggatcgtagggaccataaacgcgatagccgtagagcgcgccgggttgcagaccaggcacgtaaccgtgccagatttcatgggtatattccggcagatccaggcgggcgatctcggttttcccgtcctgatcaaacagacagagttcaacccgttctgcgtgtgcagagaaaagcgcaaagttgacaccctcgccatcaaaattggcgccaagacattcgctggttcccgccagaatttcaaagctattattgttagacatttattccctcttatatcatatggttacgtatatgacagacgaacagcaatcgacattttcaaggtggatctggtcggtaagcgccacttcttctccggtaagaagatcgcgataacgacggttagccagggccgcaggcaggttgaccgccgtctgtggccatcgttgcggggcagtcagcgcgtcgctcgcctgctgcattggcagcaccagtcgcggcgcgatgacgatcagcgcatcattaccctgctgacgggcgaaggcgatcaggtgatcggcgttatcgccttttgccgccagcggcacatagtcgccacggcggaacagatcgggtttacgctggcgataatgcagcacatgggtgatcacctgttgcttgagcgcgccgctcatccagtccgcttctgacgtcggcacaggctcgtcatcgctgaacagatgctgctcaagagcggcaaagtccggctcgcggcggttatctggatccacaaggctgaagttgagggtttcgctgccctgataaatatccggcacgccgggagcggtaagcttgatcaccgtctgggtcagactgttgaccaggcccgcgcggacaaagggttgcagcgtctggtaaaaatcttccaggaaagcctggttgtccggggagagcagatgacgggcatagtcgagcaccacggtttcatagacgtcgttgctgtcggcccagtcagtgcgcagcttcgcttcacgcagcgccttttccacaaacggaataaagcgttcttccagcgccgctaaaccggcggtgtcctggggcgtcagcgtcaccggccagacgcccgccagcgcctgatacagcatccaggcgagttccggttttggcgtcgggccatcgaacagcacggtgactttgctgtcgttcatctgatgccagcgtgccacgtgcgccgcccattcctccggcgcttcggtgagggtatagagccgtgcgcgggcatcctcaccgcgtttggtgtcatgggttgaggtgcccgacagcgcatccggctgccgttcaagacgggttttcatctcggcgtggaaacggtcgagggagaagacgcgcggtaacggttcagcgcccacttcgttaagggccagatccaggtgctgacggaagaacagcgtgtcttccaccgattttgccatcagcggcccggtaagctgctggaaacgggtgcggaaagtggcggcagccggatcagcgctggcaagaatgcccgccacgaaatcaagcgcttcggtatccggggcgtaatcgctgttttttacccgcgcaaccactttttgcagcagttgctggctggcctgcggcaggccgctggcggtgccataggtacggtaaaccgggaaggccaccagcagttcgcgcagggcggcgcgcaccaggctttcatccagcgtgcggttttgcgtggcggcgatctccatcgccaggcgcagcagggtggtgaattccccttcgaaattgcgatccgccatcagcagcttggcggcgcgcagctcggctttcatgtccaccggtttgccgaccgcctcgtcgtaggcctggcgcagcgcgtccagcttatcgtcatccaccagcacgtccgagagtgcggcaataaactcatagccggtggtgccggagatcggccagtcttccggaatgtgctcgcccttgccgaggattttttcgacggtgatgtagcactccggtccggcggtctcacgcagccgcgccagataggcctgcggatccgcaaggccatccacatgatccacccgcagtccgtccaccgcgccggaatgcaccagttcgaggatcagccggtgggtatcatcaaatacggtgtcgtcttccacgcgcaccccggccagcccggtgatctcaaagaagcggcggtaggagagatcgcgcggcgcatcgcgccaggacattaaccgccacggctgctgatcgtgcagcgcggcgatgtcagccttgtcggtcagcgccagcacctccgcttcgcgcccctgccagctggcgggcgtcagcgggtaaaagttgtcgaaataggccagcgccggacggccggtttttggatcgggcttgacgctgatctcatcgttcgccagcaccgcttcaaaggtatcgccgaggaacggcagggtcaggcggcgcgaccagtcgatatcgaaatgccgcgcgtaacggctgtcttcgccatgttcgatcacatcgcgccaccagggattttccagcgaggcggccatatggttcggcacgatatcgaggatcaaacccagaccggcggctttcagcgcctgcgccatgcggtcaaagccttcgcgcccgccaatggtcggatcgatttcgttggcgtcggtcacgtcgtagccgtgggttgagccgctggtggcggtaaacaccggtgaagcatagagatggctgatgccgagccgtttcaggtagggcaccagcgcggcggcacgatcaaaggtcatgccgttgcggaactgaatacggtaagtcgaggttgggatactcacgatacatctcccggggcaagacggacaataatggaatcaggcggcagatccgccgccggggagcgccagacatagatggtctcgccgggttgatccggcagcggctggtgccggtcgctgatattgagcgccatggagagcgtaccctgcgggaagcgccagctgacggcgagataaccttcagccgtctccaccaccttaccgctgttgccgcccgccgttgccagcagcgggacaatatactgcttacgcacatccagcagcgcctgggtaaaggccagccactcctcgccttccggcgtgtccagcttctgccagtcaagttttgaacgggcaaaggtctgctccgcattaggatccggcacgctttcgccttcatgacccgcatggccttcaaactctttcgcgcggccttcccgcaccgctttcgccagatcgccatggaaatcggtgaagaacaggaacggcctggtttcgccgtactcttcccccataaacagcagcgggatatgcggcgataacagcagcatcgccagcagcacgcgggtgcgctctgcgcccgccagggaaatcagacggtcgccctgggcgcggttgccggtctggtcatgattctggatgaaatccacaaaggcggtcggcggctggtcggtacttttcacgccgcgcggctcgccggactgcaccgaaacttcaccctgataggcaaagccttccgccagcgtacgcgccaccagcttttccggctcgcgggcaaaatcctggtaataggcgtgggtttcgccggtggcgaagacgtgcacggcattgtggaaatcatcgttccattcgccggtaaacagcggcaccgaaccgtctttttcgcgcggatgcaggaaggtgacgttacggcagtcttccgtggtcagatgcactggccgatcggtgatgcgcttgcggatgcgttcggcgatctcaatcagcagatgtttctctgaggtatcttcgatctgatcgatggcgtcaaagcgcaggccgtcgaggttgtactcttccagccagtagagcggcgcttccagcatatagcggcgggcagcgtccacatcataggcgatgcctgcgccccagggcgtatggcgctctttatggaagaactccggcgacagcagcggcagatagttgccttccggcccgaaatggttaagcacaatatccagcaccaccgacagcccgtggccgtgggcggcgtcgataaaggccttgaaatcgtccggcgaaccataggccgcatggggggcgtacagcagcacgccgtcatagccccagccgcggttgccgccaaactgcgagacgggcagcacttcgatcatggtgatgccggtttgcgcgaggtacggcagtttgtcgatggcggcgcggaaagtgccctccggcgtaaaggtgccgatgtgcatttcgtacaccacgctttcttcccatgcccggccctgccagtcggtgttctgccaggcatagtgtgccggatcgacgaccagcgacgggccgttcacatcggctttttgcgcgcgggaggcgggatccggcaccgccatgccgtcaggcagcacatactggtattccgcgcccggcgcgacgcccggcaccgtcagttcaaaccagccgtcgcccaccgcgttcatttctttgtcttccccggcaagccggagcattaccctcgggtgaccggaagcccacagacgaaaacgcacgccattggcctctgtgtattcggccccccaactcttcgtaaaggtcctggacgacatacaattaccccgtatagctcatcagtgagcacagaattgatgtgcaatggtcacgttccccacagcagttgcaaatcaatcatagttcagatacggcaactgaaagggcttctgataaagaagagatccgggcggtcgggcggcgtctgtgggggcggatggcgcttttgtgataaagctccggaccaaaaaccttaccgctatccatacttaccggcgatgccaatgaaggagggacacagaatgcgctggcaaacccacaccgtttttaatcagccgttgccgctcaataacagcaatctttttctttcagacgcctcgctgcgtgacgccgtggcccgtgaaggcgcgggctgggacaccgagctgctggcaagtatcggtcaacaactgggcacggcggagtctcttgaactggggcgtttagctaacgttaacccacccgaactgctgcgctatgacgccaccggcgagcgtctggacgatgtacgttgccacccggcctggcacctgctgatgcaggggctgtgcgccaaccgggtacataatctggcgtgggaagatgaggcgcgggcgggatcgttcgtcgcccgcgcggcgcgctttgtgctgcatgcgcaggtggaggcgggcaccctttgcccggtaaccatgacctttgccgccacgccgctgctgcaacagacgctgcccgcgccgtttcgcgactggttaaaaccgctgttaagcgatcgctacgatccgcatgtcttacccggcgcgcaaaaacgcggcctgttgatcggcatgggaatgacggaaaagcagggcggatccgacgtgctgagcaataccacgcgggcggaaaaaagcggtgatgtttaccggctggtgggccataaatggtttttctcggtgccgcaaagtgatgcgcatctggtgctggcgcaggccagcggcggtctgtcctgcttcttcgtgccgcgttttctgccggacggcacgcgcaacggcgtacgccttgagcggctgaaagacaagctcggcaaccgctcgaacgccagcagcgaagtggaattccatgacgcctgcggctggctgctgggcgaggagggggacggcgtacggcagatactcaagatgggcggactgacgcgcgttgactgcgcgctgggcagccacggcctgatgcgccgcgccttttccgtggcgctctatcatgcgcaccagcgccaggcgttcggcaaaaatctggtcgagcagccgctgatgcgtgacgtgctcagccggatggcgttacagctggaagggcagaccgcgtttctgttccatctggcgggcgcgctggatcaccgcaccgatcccgaggcggcgctgtgggcgcgactgttcacgccggtggcgaaattcgccgtctgtaaggcaggtattccttttgtggcggaagcgatggaagtgcttggcggcattggttattgcgaggagagtgaactgccgcgcctgtaccgcgaaatgccggtcaacagcatctgggaaggttccgggaatatcatgtgtctggacgtgctgcgcgtgcttgcaaaacagcatggcgtaatggatctgctgacgcaggcgttcggcgaggtgaagggccaggatcggcattacgaccgcgcctggcggcagttgcagcggctgctgcgcaaacctcaggaagcccgggcccgggagatcgcgcaacagctttaccggctggcggccggggcgcagatgctgcgccacgcatcgccgccgctggcgcaggcctggtgtcagatgatgctggatacccgtggcggcgcgctgataaacgagcaggtgcagaatcacctgctgtcgcgcgccacgggcggcgtgggttaaaggcggaacaggctgaccagctgactcagatggctgcctttttcccgcagcgtgcgggcaatatcttcactgcgtgatgcacgatcggcggtgatgtgcgtggcttcgccaatgtgcgtcatcgccagattcacctggccgataccggcagactgttcacgtgaggcgtggttaatctcggtcaccagctgattaatgttgcccatatgatcgatgatcgccgacatcgccttctgcgtctgttccgacagggcgtggccttccgacactttcgccagcgtatcggcgatcagctcctcgatctctttcaccgcctgcgcactgcgcgccgccagcgcccgcacttcctgcgccaccacggcgaaccctttgccatgctcgcctgcccgcgccgcttccacggcggcgttcagcgccagaatgttggtctggaaggcaatggattcaatgacctgagtaatggcggcgatacgctgggaggcgtcacgaatatcattcatggtcgccaccgcgcggctgacggtctggccgccctgctgtacagcgccggaggtgtcatgcaccagacgctgggtctgatccatgttttccgcggtttgctgtaccgtggccgccagctgttccatgctggcggaggtttcttccacgctgctggcctgcttgttgatctgctcggtgatctctccgctgtcggcagccagggtggtggtgccctgattaatctcacctgcggcttcgcgtacctgatgcaccatgttttgcagaccgtgaccgatgccgttaatggcctcgatcagctggcccacttcatccttgcttttcactgccagcgtggcgcgtaaatcacccgaggcatagtgctgcgccagctgaataacatcccgcagcgggcgggtcagccagcggcggatgatcaccacaaagagcgcggcaaacagcagcgagatcaccactccggcgatcaggaactgattgcgcatggtgttcacatcgcgcagcagcacggctttgtccacttctccgacaatcgtccagttccagccgggcagggcgatccacgacatcatccgcgtacggccatcagcgtcggtgcgcgccagcgtgccggactcactgccgagcagcgctttctgcgtggcgtcatcccactgcgggcgcttgccttcttcacgcggatggaacaggtaattgccataatttttaccggcgttgcgatccagcacgtagaaatgtccgctctcgccgagacgacgttgcaggatcttatcgcgcatgatgccccaggaacggctgatatccacgccgacgaagagaatggcgatgatattgccgctggcgtcttttaccggctgatactgggtgatatagcgtttgccgaacagcaatgccaggccgcgataggcctcgccgcgcatgacgggagccagcgccgggctggcgctgtccagcttcgtgccgatggcgcgatcgccgttttctttacgcagcgaggtcgccacgcgcacgaaatcatcgccgctgcgcacgaacagcgtcgcaatagcgccggtacggttcagaaaatcgtccggtacggcattattttcgtgcagctcaatttcgccgccttttagcagcggcaccgttatgccctgaatagtacgggtttgcgtggtatccacgctgatcggctgcggaataaaactggtgaataaacgcgtgtagctctcaacttcttcactgaggctggtattgaacatctcgaccatatccactacaccggtggactgactgtgaagatcttcaacggcgagggtttcgagctgttggctggcgttacgactcatcaggaaggtgaacaacaggaaaagcacagcaacgctcacgcctgtcatcagagaaagcctggtgcccagaccggcatggcgaaaagacgcgttcataaaatatccattgatcgaaaggtgtgcgtcgttcaacggcagctacgcgctaatatttagtgaatctatgtaacaaaaagtaacaagaaattattgacttagtaacagtagggtaattaaaaaccaacaaaaagaaaagccaccattaaaggtggcttcggagagctaggcataaagtatggcctgcacgcgccagttatcggcccgtcgatcctcctgcatcgcaataatgcgataccaggacgcgccctgctcatccgccttaaaggcgatgacccgttccacatcctgtgcactgccataaacattatttactgagatcaggccgatttcattaagcccggtgacgcaatcggcactggcgaattcggcggactgcgccgttgtgctcactaaacccagtgagagcagcagcgtggttaaggcaagcgatcgtttcatttgtcagctccatttaacgttaccctgagtcatggcagggcaatccatcgcgtataaatcctctcccttgccgaagcatcgaatttattgtgcacaggaatacgtctaaaggtgcaaagcagtgtaaatcaaccttaaaaaacaatgcgccgttactgacgatacaaaatggcctgtgaataccactggccggtaaaaacagtatcgtcattgagaagaatgacgtaataatccgctttagctgcggcggctttggctttgatttccgcctccgcatccatcggagagcctttaaccatcacgctgatggtgcctaaacgctgtaaaccttcagtctgattgcggctgatctcctgcggctcactcttcgccggaggcgggggctgcggtgtaccctgtaatgcgctacagccgctcagtaataatgccagtacaacaggggcgaaccggctcattgttgtttctcgtttcctgattggcatagtgtagttcctcgtgaatttccctttgggggaatgttcccgaaatgttatctgaaacgtgatttttgactaaaaatcacccgaaagcgtaatggacgtctcaccattatggcaaaacatcgtcgatcgtggtttgtgtgacgtcaccctgcgtggcatatcggcaaaataaagcaggagagcctgatgattgaactggaaacgcggcagtttgccggcattgaaacccttcacgccacgcctgccggacagcgcgctcagccgctgccgacggtggtgttttaccacggctttagctcatcgaaactggtgtacagctattttgccgtcgcgctggcgcaggcgggcataagggtggtgatgccggacgcgcgggatcacggcgcgcgctttaacggcgacgccacggcgcggctcggacagttctggcagatcctgcacagcaatttacgggagtttgacccgctgcaaagggcgctttacgacgccgggctgattaaggatgcccggctggcggtgggcggcgcgtcgatgggcggcatgacggcgctgggcatcatgacgcggcatccggaagtgaaatgcgtcgccagcctgatgggatccggctattttacgacccttgcccgcacgctgttcccgcctgcggatctgcaacaggccgtagcgccgcttaccgactgggaagtttcccggcatttaccccgtctggcagaccggcccctgctgctgtggcacggcgaggaggacgacgtcgttccggcagtcgaaacctggcgattacagcaggcgctgacgcaggccgggctggatcagcagctaacctgcgtatgggaagcaggggtgaaacatcgcattacgcccgttgcgctggacgctaccgtcgatttcttccgcgcgcacctttaaacgcacatcacctgcacgccctggctctcaagctgtctgatgatgtcagggttggcctgtttgccggtgatcaccatgtcgatttgatcggcgcggctgaacagcatcccggcacgttcgcccactttgctgctgtccaccagcaccaccagctttccgaccacgttcagcattttctgctccgccatggcggtcagcatatccgttttgtacagcccgtcggcggccaggccttttccgctggtgaacatccagtgtccggcatagaggctgttttcactgccctggggactgagggtgatggcctggcttttgttgtactgcccgcccatgatcaccacgctttcgtgctcctgatcgatcaggtaattcgccagcggcaggtaattagtaatgatttgcaccggcttgccgcacatttcgcggcccagtaaaaaagcggtggagccacagttgatcaccacgctctcccccggattgaccagttgcgacgcggctttggcgatacgtactttctcatcaagattttgcgcctgatgaatgttcatcggcgtccagcgcgggcgctgctggctgatggcctcggcaccgttgcgcacctttttcagcttgccgctctcgtcgagcttgttgatgtcccggcgcgcggtggcaggggagacatccagccgcgccatcacctgctcgacggtgataaaacccgtctgcgccagtagttccagcagaatttgatgtcgttgcgcttctgtcatgagctattccgattggtgatgatttttttagatgatatttgaaatagcctgcgattactaagcgttaataaaaaaatgccggcccggcagcacaggccgccggacgcgaaacctgtggcgatcacaggaaggatttgaacggtaaatcaggctcaatggtaaagcagtcgtcaaagccgcgcgggtagtgatattcaaatttgtctttatccagcggccaggtaaatttaccgcccacctgccagatgaagggtttgaagccatattgcaggcgatcctttttcatctcccacagcacgcgcagctcctgcggatccgcctggaaattcgaccagatgtcgtgatgaaaggggatcaccactttggcgttcagcgcttccgccatgcgcagcagatccacgctggtcattttgtcggtgatgccgcgcgggttttcgccgtacgagccgagagccacgtcgatctgatggtcgttgccatgcttcgcataatagttcgagtagtgcgaatccccgctgtgatagagcgagccgcccggcgttttaaacaggtagttcaccgcgcgttcatccatgccgtccggcaggatcccggcggcttgctgatccgcgggcagggtgatcaatgccgtgcgatcaaaagcgtcaagggcatggatctcaatatcttttatcttcaccacgtcgcctggtttcaccacgatgcagcgctcgtgcggcaccccccagctaacccacagatcgacgcaggtctgcggcccgataaagggcaccgtctgcggacagttttgcatgaccgccgccgccacgtttacatcgatatgatcgttatgatcgtgggtggcgagcaccgcgtcgatctcgcggatggcgaaaggatcgagcacgaaaggcgtggtgcgcagattcggctgtagctttttcacccccgccatacgctgcatctggtggccggttttcatcagcggattgccgtggctttgtttgccggtaccgcaccagaaatccacgcagacgtttgtgccgccctctgacttcagccagatgccggtgcagccgagccaccacatggcaaaggtgcccggcgccacctgctcctgctcgatttcttcattcagccagcttccccattccggaaaagtgctgaggatccatgattcgcggctgatgctttccactttgctcattctgtactcctcgctttttatgtcaaatgtaatcataaaatgatttattgtgatttatgttgtcacgcttttttcagcaatgcaacgaggtggtttgcagaaattgtgcgaggcgcgttcaggttttgcgcggtttatatcgtggaagagcagatctgttttttatatctctctgtaaatgatattaattttttgccatgacgaatagccactcttggtatgaggaaataaattgcgcggcgcatcacaaataatcaaatgcaatctttttgtgattatttttgattgttagagtgtgcgcacacccggtaccgatgcccggtgccctttaccctccggagagagttatggagatcctctacagcgtctttaccgttttctttaaccaggtcatgaccaacgccccgttgctgttgggtatcgtcacctgcctggggtacatcctgctgcgtaaaagcgtcagcgtgatcgtcaaaggcacgataaaaaccattatcggcttcatgctcttacaggcgggatccggcattctcaccagcacctttaaaccggtggtggcaaaaatgtcggaggtgtacggcattaatggggctatctcggacacctacgcctcaatgatggccaccattgaacgcatgggagacgcctacagctgggtgggatatgcggtgttgctggcgctggcgttaaacattttatatgtgctgttccgccgcgtgaccggcattcgcaccattatgctcaccggccacattatgtttcagcaggccgggctgatcgccgtgttcttctttatcctcggctacccgatgtggaccaccgttatctgcacggcggtgctggtgtcgttgtactgggggatcacctccaacatgatgtacaagcccacgcagcaggtgaccgacaactgcggcttttccatcggccatcagcaacagtttgcctcctggctggcgtacaagctcgccccttacctcggcaaaaaagaggagagcgtggaagatcttaaactgcccggctggctgaacattttccacgacaacatcgtttccaccgccatcgtcatgacgctgttcttcggcgcgatcctgctctccttcgggctggatgtggtgcaggcgatggccggtaaaatccactggactatttatatcctgcaaacgggttttcagttcgcggtggcgattttcattatcgtgcagggcgtaaggatgttcgtcgccgaactctccgaagcgttcaacggcatctcccagcggctgatccccggcgctgtgctggcgatcgactgcgcggccatctacagcttcgcgcccaatgcggtggtgtggggctttatgtggggcaccgtcggccagctgattgcggtgggtatcctgctggtgtgcggctcctctattctgatcatccctggttttatcccgatgttcttctctaacgccactatcggcgtcttcgccaaccacttcggcggctggcgggcggcgctcaaaatttgcctggtgatgggcatgatcgaaatctttggctgcgtatgggcggtaaaactcaccggcatgaatgcatggatgggcatggcggactggtcgattctggcgccgccgatgatgcagggcttcaccctcggcctgtggtttatgggcgtcattatcctgattgcgctggcgtacatgttctttgcaggacgggcgctgcgtgcggaagaagatgcagaacaccctctggcagaaccttctgcccaataaaaggagtagagcgatgactgtacgaattctggcggtatgtggtaacgggcagggcagttccatgatcatgaaaatgaaagtggatcagttcctgacgcaacagggcgtggaccacagcgtgaacagctgcgccgtgggcgaatacaaaagcgagctgggcggggcggacgtgattatcgcctccacccatattgccggtgaaatcagcgtcagcggcaacaaatacgtggtcggcgtgcgcaatatgctgtcgcccgctgatttcgggccaaagctgatggaagtgatagccgcgcactttcctcaggatctgaagtaaggacgcgccatgaaattacgtgattcgctggcggaaaataagtccattcgtttgcaggccgaggccagcagctggcaggaagcggtgaaaatcggcgtcgatctgctggtggccgctgacgtggtggaaccacgctattaccaggccattctcgacggcgtggcgcagttcggcccgtattttgtcatcgcgcccggccttgctatgccccatggccgcccggaagagggcgtcaggcgcaccgggttttcgctggtgacgctgaaaaccccgctggtgtttaaccatgaggataacgatccggtggatatcctcatcaccatggcggcggtggacgccaacattcatcaggaggtgggcatcatgcagatcgtcaacctgtttgaagatgaagccaatttcgaccgcttacgggcctgtcgcactgcgcaggacgtgctggatctcattgatgccgctgatgcggcggccgtttaagagggacttactatggcattacctatgttgcaggtggcgctggataaccagacgctctcccacgcctatgaaaccacccgtctgattgctgaagaggtggacattattgaggtcggcaccatcctgtgcgttggcgaaggcgtgcgcgccgtgcgcgatctcaaggcgctctatccgcacaaaatcgtgctggcggacgccaaaatcgctgacgccgggaaaatcctctcccgcatgtgtttcgaggcgaatgccgactgggtgacggtgatctgttgcgcagatctgaacaccgccagaggcgcgctggacgtggcgcaggagtttaacggcgacgtgcaaattgagctgaccggttactggacctgggagcaggcgcagggctggcgcgatgccggtatcaggcaggtggtgtatcaccgcagccgggatgcgcaggcggcgggcgtggcctggggcgagtcggacattgccgccatcagacggctggcggagatgggctttaaggtgacggtcaccggcgggctggcgctggaggatctgccgctgttccagggcattcccatccatgtctttattgccgggcgcagcatccgcgatgccgcctcgccggtggaagccgcccgccagttcaaacgcaccatcgcacagctgtggggctaaggagcggctatgttgtcgaaacaggtgccgctcggcatctatgaaaaagcgctccccgccggggagtgctgggctgaacgtttgcagcttgccagaacgctgggttttgattttgtggaaatgtccgtggatgaaaccgacgcccggctttcgcgccttgactggagccgtgagcaacggctggcgctggtcaatgccattgccgaaaccggcgtgcgggtgccgtccatgtgcctgagcgcgcaccgccgctttccccttggcagtgaagatgaccacgtgcgtcagcaggggcttgcgatcatgcgtaaagccatccagttcgcgcaggacgtcggcatccgcgtgatccagctggcgggctacgacgtctattaccagcagggcagtgacgaaacgcgccgccgctttcgtgacggactaaaagagagcgtggtcatggcgagccgcgcccaggtgacgctggcgatggagatcatggactacccgttgatgaactccatcagcaaagcgctgggctacgcccattacctgaataacccctggttccagctctaccccgacatcggcaacctgtccgcatgggataacgacgtacagatggaactccaggccgggagcggacatatcgtcgcggtacacgttaaagatacccgcccgggtgagtttaagaacgtgccctttggcgaagggattgtggattttgaacgctgcttcgccaccctcaggcagagcggctactgcgggccgtacctgattgagatgtggagcgaaacggccgcggatccggcagccgacgtgatcagggcgcgggactgggtacgtgagcgcatggcgcgggccggtttacaggaggcggtataatggaacgactcagacagcaggtgtacgacgctaacatggcgttgccgcgctacgggctggtgacttttacctggggcaacgtcagcgccattgaccgcgaacgcggctgggtggcgatcaaaccgagcggcgtggcgtatgaaaccatgacgcctgacgatatagtcattgtcgatctcagcggcagggtgttgcacggatctcttcatccttcctcagacaccgccacgcatctggcgctgtaccgccgttattctgccctcggcggcgtggtgcatactcactcaacccatgccaccgcctgggcgcaggcaggacgggcgatcccggcgttgggcactacccacgcggattactttgccggagatattctctgcacccgcgcgttaaccgaacaggaagtacgggaagagtacgaactcaataccggcagggtgattattgaaactttgggcgacgccgatccgctgcatacgccggggatagtggtgtatcagcacggcccctttgcctggggaaaagacgccgctgacgcggtgcataacgcggtggtaatggaagaggtcgcgcgcatggcgtggattgcctacggtattaatccgcatttaaagcccatcgacgaccacctgctggagaagcatttcctgcgcaagcacgggccggacgcctattacgggcagcggtgatcaccgcgtagacccgttttacgcggtgtgcgaattatttgtgcaattagcttgagttcggtgggcgtcgcaagtatgattacgcgtcaatttttcagccgcctttcaaacacgttccttgcttccatgggccgcggctgaccctgacaggaggctgaataatccgtaaggagcaattcgatgcgtcattacgaaatcgtttttatggtccatcctgaccagagcgaacaggttccgggcatgatcgagcgttacactggtgcaatcactgcagcagaaggtacgatccaccgtctggaagactggggccgccgtcagctggcttatccgatcaacaaactgcacaaagcccactacgttctgatgaacgttgaagcgccgcaggaagcgatcgatgagctggaaactaacttccgcttcaacgatgccgttatccgcagcatggttatgcgtaccaaaaacgctgttactgaagcatctccgatggttaaagcgaaagacgagcgccgtgagcgtcgcgatgatttcgcaaacgaaaccgcagatgctgatgatgctggggattctgaagagtaatttctgatgaccaaccgtctggtgttatccggcaccgtgtgcaggatgccccttcgaaaggtcagtccatcaggaatacctcattgccagttcgtgcttgagcatcgttctgtgcaggaggaagccggtttccaccggcaggcgtggtgccagatgcctgtaataatcagcgggcacgagaaccaggccattactcacagtataacggtcggtagcgcagtcaccgttcaggggttcattagttgccataaggcaaagaacggactgacgaaaatggtactgcatgccgagcagattgatttgatagattctggagactagccaaatggcacgttatttccgtcgtcgcaagttctgccgtttcaccgcggaaggcgttcaagagatcgactataaagatatcgcaacgctgaaaaactacatcaccgaaagcggtaagattgtcccaagccgtatcaccggtacccgtgcaaaatatcagcgtcagctggctcgcgctatcaaacgcgcacgctacctgtccctgctgccgtacactgatcgtcatcagtaatcggtcacggtccattaatacgactttgagaggataaggtaatgcaagttattctgcttgataaagtagcaaacctgggtagcctgggtgatcaggttaacgttaaagcgggttacgctcgtaacttcctggtaccgcagggtaaagctgttcctgctaccaagaaaaacgttgaattcttcgaagcacgccgtgctgaactggaagccaaactggctgacgttctgtccgctgctgaagctcgcgctgagaaaatcaacgcactgggcaccgttaccgttgcgtctaaagcaggcgacgaaggtaaactgttcggttccatcggtactcgcgacatcgctgacgctgtaactgcagctggcgttgacgtggctaagagcgaagttcgtttaccgaacggcgttctgcgtaccactggtgagcacgaagtgagcttccaggttcacagcgaagtgttcgctaaagttatcatcaacgttgttgctgagtaatctgcaacccacgttttgataacaacgaaacgccggccttgtgccggcgttttgcttttctgccttctactattctgatcctgtactgactggctattgcttaaccttttcgcgataatagaaaaataaaacattattttattttttggtgaaggaatggacacaagccaccagccgcctctgtttgcccgcaaaaacgtcgtctatatgggcgcagcgttctgctgcctgctctggggcagcgcctatccggcgatcaaaagcggctacgagatttttcagatcgccaccgacgatatcccgtcaaaaattgtctttgccggttatcgcttcctgtttgccgggctgttactgctgctgttcgccatgatgcagcgtaaacccatcgcccgtctgagcggtcgccagtatgggcagctcgccgtgcttggcctgacgcaaacgtcattgcagtacatcttcttttatattgggcttgcgttcaccaccggcgttaaaggctcgatcatgaacgccaccggcactttcttcagcgtgctactggcgcatttcatctaccagaacgacaaactgagctacaacaaaacgctcggctgcgtgctgggctttgccggggtgatggtggttaacttcaacagcggcatggatttcagcttcacgctgatgggcgacggctcggtggtgctggcggcgtttattctctcggccgccacgctgtacggcaagcgcatttcgcaaacggtggatccgacggtgatgaccggctatcagctggggatgggcggtctggcgctggtggtggggggctatctcacgggcggctcgctcaccctgcacggcttcgcctcggtggccattctgggctatctgacgctgctctcttccgtcgcctttgcgctgtggagtattctgctgaaatataaccgcgtgggcatgatcgcgccctttaacttcctgataccggtgtcgggcgcggtgttgtcggcgattttcctcggcgaaaacatcctggaatggaaatatgcgctggcgctggtgctggtgtgctccggcatctggtgggtgaataaagtaaaaaaggggaacgcctgacgttccctctctgttcaacacattaataattaacgcgcgcggataaagctgccgtccgtctggcgggtaaacagcacctgctgatcgccgctggcttcgatggtcagccctgtgaccacgccgttggcgttctggcggattttcacaatctgccccgtttgcaggttgctgagcggcttaccattgccttcaacctgcgccatcgcatagacatccgtcggcggcagattatggtcgcggaacagctgcgccagcgttttacccggttcgacgcgataggtgcgccactgctgctcaatgccggtcggctcctgcaacggcgcgctgttctgcgtggtcggcggctgttcctgttcttgctcctggatcggctctggcgcaataggcgccacctggccgtcgttttgcggcgacgagaccagcggcggctgttcgggctgcgcagtctgttgcgactgaggctgtgactgcgactggagatcaagttgcgcatcgcgggtggaggacgacacgtcgctgtcgtcggtacccggcagcaggaacccgataacgatcagcgcagcggcgaaaataatgccacggcgatggcccggcggcagcggatccatgatgcgcacgttgtccggcgcgtgccagatcctcgccagggttggttttagttcaaatcgcccgggcatggctttcctcctgctccgcgtcgttagtatcctgtgtcactgagtatagtttgctaactgcctgatgagcgtagtaaagcacgctttcgtgacctcagttcgggaaaaatcttaccgccaccattgtttctttttccctgcgatttgtcatcaatccccgcgacaaagttttacccgtcgcagcctgactgttatgctgcccgctactttaaatgcgatgaaaggaaaacccatgacaaccccgacttttgacactatcgaagcgcaggcaagctacggcattggcctgcaggtagggcagcaactgagcgagtctggcctgcaggggctgttaccggaagcgctggtagcgggcatagctgacgcgctggcaggcaaacagccggcggtaccggtcgatgtcgttcaccgtgccctgcgtgaaatccatgaacgcgctgacgcagtccgtcgcgagcgctttgaagcgatggcgtctgaaggcgtgaaatacctggacgaaaatcgtgagaaagacggcgtgaacagcaccgaatccggtctgcagttccgtgtactgactcagggcgaaggtccgatcccggcacgtactgaccgcgtgcgcgtgcactacaccggtaaactgatcgacggcaccgtgttcgacagctctgtcgcccgtggcgaaccggctgaattcccggttaacggcgtgatcccaggctggatcgaagcgctgaccctgatgccggttggctcgaagtgggaactgaccattccgcagaacctggcgtatggcgagcgtggcgcaggcgcgtctattcctccgttcagcaccctggtctttgaagtggaattactggaaatcctgtaatttcccgcaaagtagccctctcccgtaaccgggagagggtattttctctccgcacatatgccgttctttagctcagagtcgatatttaatgttgcaaatgcatttgttgcgtgtatttttgtgacctgattcgcacagacgaagtgatataacactcagtttaaacataaatttaacatctcattcaaaacacagtattcatccctccgattcttacctactatcgatgagtcaaaaaaccaaggcattgtcacgcacgtgacactatgaaaggccagaagagcctcaacaacgcagacaggtacaggaataaatacatggtagatcaaacgaaggtcgccgctgaccagcaggctccggcggagcaatcgctacggcgcaatctcaccaaccgtcacatccagcttatcgccatcggcggcgctatcggcaccggcctgtttatgggctcaggtaaaaccatcagtctggccggcccgtcgatcatatttgtctatatgatcatcggctttatgctgtttttcgtgatgcgcgcgatgggcgaactgctgctgtcaaatctggaatataagtcgttcagcgatttcgccgccgatttgctggggccgtgggcgggttactttaccggctggacctactggttttgctgggtggttaccggcatggccgacgtggtggcgatcacctcttatgcacagttctggttccccaacttatcggactgggtggcttcgctggcggtgatcctgctgttgctgagcctcaacctcgcgacggtgaagatgttcggcgaaatggaattctggttcgcgatgatcaagattgtcgccattgtcggcctggtcgtggtgggtctggtgatggtgctgaccgaattcacctcaccgagtggcgtacaggcctctttcgcgcatctgtggaatgacggcggctggttcccgaaaggcatcagcggtttctttgccggtttccagatcgcggtgtttgcctttgtagggattgaactggtcggtacgacggccgcagaaacgaaggatccggaaaaatccctgccgcgcgccattaactccattccgatccgtatcatcatgttctacgtgttcgcgctgattattattatgtcggtgacgccgtggagctcggtagtggcggaaaagagcccgttcgttgagctgttcgtgctggtcggcttaccggcggcagcaagcattatcaactttgtggtgctgacttcggccgcctcgtcggcaaacagcggcgtgttctccaccagccgtatgttgttcggcctggcgcaggacggggccgcgccgaaaagcttcggtaagttgtcaaaacgcgcggtaccggcaacgggcctgaccttctcttgcatctgcctgctgggcggtgtggtgatgctgtatgttaatccgagcgtgatctctgccttcactatgatcaccacggtgtcggcgatcctgttcatgtttgtgtggaccattattctttgctcgtatctggtctaccgcaaacagcgtccgcacctgcatgagaagtcgatttataagatgccgctcggcaagctgatgtgctgggtatgtatggcgtttttcgtcttcgtgctggttctgctgacgctggaagaagatacccgtcaggcgctgatcgtcacgccgctgtggtttatcgtgctgggtgtgttctggttcttagtgggtaaaaagcgtatggcacgtatgcgccgctagtcacctgtaatgccggatggcgctgcgcttatccggcctggacaataatcccgttcacgtaggcccggtaagcgtagcgccaccgggcaacgtcgttactccccgcttaacgcccgcggaaacagcacattattttccaggctgatgtgctccatcagatcgtcaatcagttcattaatgccgttatacatcgctttccaggtggtgcaggcttccggcggcggcgtcacgttattggtggtgtgtttgatcacctccagcagttcccccgcttcatcatgttcgctctccatgacgttaatcggcccagcggcgtggctgcccatgccctgtttgatcatcgggaagaggatctgctcctctttcatcatatgactggaaagctcctgatgcagcatggtcaggtatttggtcaggccgcgcggcacgttgggtttatcggcatggacgcgctcgactttggtggcctgcaggatcagctccggcaactgttcgcggtggcgatcgtggtagcgcacaatgatgtggtcgatgatgtgaggaagcggctccacgcgccagtctttctccaccggctgttcggccagtttcgccagctgcgcttcaatcaccgccacatccagctccttacgagccgcggcacgtgccagcgtctgcttacccccacagcagtagtccatatcgtattgacggaacagggcagaagcgcggggaatggacagcgccagctcacctaaaggttgatcgcgaaaggccataacagttacctcgttagtcagaatataagatgcattttaaatgcatctttaagccgaggctataccccttatgagtgacgggattaatttgcccatttttgtgcgctgtgtcacaaaaaattcctgcttataacgtattgaaactacttgttaaagtgaagatttggtatcgagtgtgcaatatcttcgttaaacatgcgttaaaacctgccgatatagacccgtcacataaaaatcctgcatccgataaaaggttcccgatgtttaaacgtgtaaaagtaataaccctgttaataatggtgcttttcgtgctcggcgcgatgcaactgattgctgcgggtgtgtttatcaatgcgctcaacaatgacaaacagaattttaatgtttcccaggtctccagccagaacgtggcggaatttaccgatgcctggatcagcctgaaccaggcccgcgtgacgcttaaccgcgggatgttacgtctgcaaagcagcaccgccagccagatcaacggcggcgagctgggtgagctggtgaaaaccgcgaaaaacctgctggccgatgcgcagaagcattatgaaatctacgacgcgctgccggaaacgccgggtatggatcctcgtctgccgcccgagctggaaaagcagtacggcatctattccaccaccctgaccgaaatgaaccgcctgctggcggcgggcgatctggaagccatgttcaggcagggcgcggaaagcaaacaggtcgccatgcagagcgtctaccgcgaatggcgtgctgcgcaggctgagctggccaacaagggcgtcatcgataacgaaaatgattatgtgcgcatcatgtggatcctcagcgccattatgttgctggtggtggcggtgatcgtcgccagctggatcgccatgcagcgcgtgctgctgaagccgttacatgaagtaatggctcacatccgccacatcgcggcgggcgatctgacccatgaaatcgatgcggaaggcaaaaacgaaatggcgctgctggcgtcaaacgtacgtgaaatgcagcaggcgctggcgaccaccgtcagcgtggtgcgcgatggcgcggacactatctttaccggcgcaggtgagatctccgcaggcagcaacgatctctcctcccgtaccgagcagcaggccgcttcgctggaagaaaccgctgccagtatggaacagctgaccgctaccgtgaagcagaacgccgataacgcccgtcaggcgacgcagctggcgaaaaccgcctcggaaaccgcgcagaaaggcggcgcagtggtcgacggtgtggtgcgtaccatggatgaaatcgccaacagctccagcaaaatcgcgcagatcaccaatgtgatcgacggcattgctttccagaccaatattctggcgctgaacgccgcggtggaagccgcccgtgccggtgagcagggtcgtggctttgcggtggtagccggtgaagttcgcaccctggcaagccgcagcgcgcaggctgccaaagagatcaaagcgctgatcgacgattccggcagccgagtggatgcaggttcggcactggtgcatgaagccggtgaaaccatggcggaaatcgtcagcgccgtaacgcgtgtgaccgatatcatgggcgaaatcgcctcggcgtccgacgaacagagccgtggtatcgaccaggtgggtcaggcggtggcggagatggatcgcgtgacgcagcagaacgcctcgctggtggaagaatccgcggcggcggcagcggcgctggaagagcaggcctccctgcttaacgataccgtggcggtgttcaaagtgaaacgtcgcgccccggctgccgtagcaaacgcgcgtccggcggcggtgaaaatgaagccggttgccgcgactacagacgcgaactgggaaaccttctaagcctgatgcccggcggcgcaggcttgccgggcctggatggtggaactcctgcccggcggcgcatgcttgccgggcctacatgtcctacatgttcatcatcatgtaggccgggtcaggcgtagccgccacccggcactatcatccgttcaccactcgttttacccgtaccgcgatcaccacccccagcaccagcagcgcaatccccgacaccgtcaacagcggcggcacgctctggcgcagcaaaaaggtatacagcaagcccgccagcgtttcgaagacgatcaacggtccaaggatcaccgtcggcaatttctggctggccaggttccagcacagcgcccccacccatgaacacaaaatggcaatggcggtcatcaggccaataaataccagcgggcgtggaccaaacggcagcgcaaatcccggctgatccgcctgtaaccacacacaggccgcaatatagcccaccagcgacaccggtagcgtcaccaggccctgcgccgttgcccacatcatcggatgacgcgtgggattttcccgcagccagcgggcgttacgcagtgcataccacgcccagcacgccaccgacaccagcgccagcgcgatccccgaaccatagcgccacccgctgaaattcggcagcccgtgccgcagttcggcgatattcacacacaccagccctgcggcgatgcacagcagcgcgggcgcaaggcgcagccacggcagcttgccgtcacgcttgctgtagagcagattcgccagcaccggcagcaccaccggcagcgtgccgatgatcatcgttgagacgggcgcgccggtacgctgaatagcgctggcgagacaaacgtaataaaccaggttgcccgacagggtcagcgccagggcgatcaaccagtcatgacggcttaactgacgcagacgtacgcgccccagccaggccagcggcacggcgataagcccgagcgccagataacgtccggtcgactgcaaaatcgccggataatccggcaccagcagcggcccgacaaaaatcagtccccacattaaccctgcggccagggcgtacagcacaccactaatcatcctgccatccatattattcatgttgatcggcagtgtagggcagggcagagaaagaatattgtatgaggttgcgcatcagcggcgggcgacctgcttctggtagcgtaccggcgtgatgccataacggcgggtaaaggcgcgggtcaggtgcgactgatcggtcagcccggtcagggcggcgacatcggcggcgggcaggccgtgggtaaggaaattctttgcccgccacaggcggatcgccatcagcatctggtgcggggtgacgtgataatgggctttaaactgacgctggaaatggtacgggctgagggacgccacgcgcgccagttcgtcgagggtcagcggctgcatatagttatcatgcaggtactcccgtacgcgctcaaaacggtgcgccccttcggcactgaccggcgcatgacgggccagcggctgaaaagcgtcgatcaaatcgagcagataaccctgctgcgccagcgtgtcgtcgctatgccacagggcatggatcagggcgcaaatctgccgcgaacgcagcggatcgtgacgggaggcgtcagcaaaccaccagtggcggatgccggtgacctgctccagcaagtcaggctccagataaatcatgcgatagcgccagccgtcagcggtttccgcttcgccggtgtgcagttcatcaggattcatggtgacgacggagttcaccggggcgacgtgctgcgcgccgcgatagcgaaaacgctcggcaccggcttctatggcgccaataccgaaggcttcgtgggtgtgcggctcaaaggcgtagcgggagatatgcgcctgatacagctcgacgcccggcaactgcggcaggtgccgaaaacgggcgcggtctttctcatcgctgaactgttccggtacgccttgcacattcactctccgcctgggtcatgccttcattattaaggatgacccggcggcatgctacaaaaattaaccagtttgtaacagttacaggatggctttaatgctgtcggcaagcggcgtggtcgggcgaccaatcagtttgctgagcgtatggctgtcatcaaacagaccgccttttgacgcgccggtgtcggagtccgccagcaggctggcgaaggcgtccggcaggccgacaccgcgcagggcggcggcaaaatcagcctcgctgaggttctgataaacgacgtttttaccgctctgcgcagacagttccgccgccagttcgctgagcgtccaggcctgatcgcccgccagctcatacaccttaccggcatggccgtcttcactgaccacttttgcggcggcagcggcgtagtcttcccgggtggccgaggcgattttgccgtcgcccgccgcgccgataaacacgccatgctccagcgcaggcggggcgctggcgaggtagttttcactgtaccagccgttacgcagcagggcgtaaggaatgccggaggcggcgagcagtttctccgtttcgatatgttctgcggcgaggccgagcggtgaggtatcggcatgcagcaggctggtataggcgataaaaccgacgcctgcggctttggctgcgttgatcacattgcgatgctgggcagtgcgctggcccacttcgctggaggagatgagcagcagtttctcaacgccttcaagcgcgcgggttaatgccgcttcgtcgccgtaatccgcctgacgcaccacgacgccctgttgcgccagcgcgtcggctttcgcggggttacgcacaatggcgacgatctggctggcgggaacggttttttgcagggcggcgacagctaactgaccaagctggccggtggctccggtaatggcaatcatggaaaactccttcgtctctgggttgtgttatgagacactatcaccctgactcacttttagtaagtacgtacaaaaaggttagtatgaagaaaattgaacgtcctgccacgctcagcgagcagctgcgcgacggcaatttattcgccgagcagtgtccatcccgggatgtgcttaaacatgtcaccagtcgctggggagtgttgatcctggtggcgctgcgcgacggcacgcaccgtttcagcgaactacgccgcaagatggggggcgtcagcgagaaaatgctgtcgcaaagcctgcaatggctggagcaggacggctttatcaatcgggtgtcctatccggtggtgccgccccatgtggagtacagcctgacgccgctgggcgagcaggtgagcgagaaagtggccgatctggcggactggatcgagctgaatctgccgcaggtgctggcgcttcgcgacgagcgtgctgcgtaaagtgccgggtggcggtgcgatatatgccgggtgtcggctgcgcctaacccggcctgggggacggtgaacatgtaggcccggcaagcctgcgccgccgggcgttgtgtcggttgatgtgcggcgtggcttattttccgcctaaatccagctgataaattgcgaaaccgatgtcgtcggtgccggtatttttcatcggatactgcgctttctctttgataaaggccgccgctttttccgacggcgaggtctcaaagcgaatatcgagcggcgttttactgtggataggggccagacgccagttattatccgccgccgggtggatctcacccgcgcgcgccgactcgtcgccgatccacttcgccagcacggcgcggttttcatccggcgacgcgaacgcgatatggctgtcgccggtaccggcaaatttgccgccgtaagcgcggtagttattggtggcgacgaggaaagtggccgccggatcgacagctttgccgttgaaggtcagatccttaatacgctccgctttcgggttcacgctctggcattcaccgtcgtaacgcgcgggctgcgtgatatcgatctgatacttcacgccgtcgatgacatcgaagttataggtgcggaaaccgtcccagttgatcagcgactgcggtttgctgctgttcacatcgatctgattaaactgcccggcggagcactccagccactctttcagttcgctaccgctgactttcaccaccaccagggtgttcgggtacagatagagatcggcggcgttacggaaggtgagctggcctttttccacctcaacaaagctcgccggatcgtttttacgaccacccactttgaacggcgcggcggcagacagcaccggcagtttcgccagatccggatcgccctgaataaaatgctcaacgtaggctttttgcgcgttgttcaccacctgcaccgtcggatcgtcctgcaccagcgccagatagctgtacatgttatcggcggatttgccgatcggcttgctgacaaactcccgcgtcgcgtcgtggtcatgcttcagcacgtccaccagtttgctgtcttcagcggccagcgattttttcgccaccgcgtcgtaaatcggacgcgcttccgctttcgactgcgtgacctgccatttcccgctgtcattgctcagcgtcagatccaccacgcccagatgatcgccccacatgcccggcatcaccgacggcacgccgtttagcttgccgttctccacgtccgcgcccttaataccggcgaagtcttttgacgggaagaccgcatgagcgtggccgaacagaatggtatccacgcccggcacctggcttaagtagtacacggagttttccgccatcgcctgatacggatcggcagacaggccggagtgggcgaccaccaccaccagatccgcgcctttttcacgcatctcaggcacataacggcgcgcggtttcggtgatatcgttgaccgtcactttaccgtcgagattggctttatcccaggtcatgatctgcggcggcacgaagccgatataaccgatacgcagcgtatgatctttaccgtctttatccttaaccgtggtttctttaataaggtaaggggtgaacagcggttttttggtcttaacgtcgatgatattggcgttaacgtacgggaatttcgcccctgccagcgcattgtgcagaaaatcgagaccgtagttaaattcgtggttgccgaggttgcccaccgcataatccagcgtatttaacgccttataaaccgggtgcacttcgccttttttcagtccgtggctggcgacataatcgccgagcgggctgccctggatcaggtcgccgttatccaccagcacgctgttagtggcttcactgcgggcggcgttgatcagactggcggtacgcaccaggccgaacttttctgtcgcgctatctttgtagtaatcgaagtccatcatattgctatgcaaatcagtggtttccataatacggagatccaccgttgcggcctgcacgctggcggcgatcagcgtggccaggagcgttgcgctaaacttaatcatcagagatgtcctttttaagatctaagccacaaaagagaatgtatttacattttgttgcttacagaattgtgaatcttgccataaaagttgccatggaaaccggaatcactatcacagatggcggatccctttatgatgcgatataagtaaaacaacgagttaacccactgaaataaaaaagaggtggacgatgttagatgcaatttgtcagcttgcccgcgaggcaggggatgcgattatgcaggtgtacgacggccatcagccgatggacgtcaccagtaaaaccgatgactcacccgtaacggcggcagacattgccgctcatcaaattattgtgcaggggctggtggcattaacgccggatattcctgtgctctcggaagaggatccgccgtcctgggaaattcgtcagcactggcagcgctactggctggtggatccgctggacggcaccaaagaatttatcaaacgcaacggcgagttcacggtgaacattgcgctgatcgaaaacggcaagccggtgctcggcgtggtctacgcgccggtgcttaacgtgatgtacagcgccgccgacggcaaagcctggaaagaagagagcggcatccgcaagccaattcaggtgcgcgatgcccgtccgccgctggtggtgatcagccgctcgcacagtgatgatgagctgaaagagtacctgcaacagctgggcgagcaccagactacttccattggctcgtcgttgaaattctgcctggtggcagaagggcaggcgcagctttatccgcgctttgggccgaccaacgtctgggatacggcggcgggccatgcggttgccgccgccgccggggcgcacgttcacgactggcagggtaaacccctcgactatacgccgcgtgaatccttcctcaaccccggcttccgggtttctatttactgagtaactggcgcagcagggcgactacctgctgcgcttcttctggcgtcagcgcgccatctttcgcccactggacccgtccgtctttatccagcaccgccaccgcagagctttcttcatccagttgccaggctttacgcgccaccccgtcgctgtcgacgataaactgtgaccagggatagagctttttattgctctcaatgctgctgcgcacaaacatcgccgaaccgggaatggcatcatcggtattaatgatggtggtggtctggtaacggtcgtggggcaaattcgctgatttgatcgcttcgatcagcgcggcatttttctcttttgctgacgaacgaccggcaatatgttgcaccacccgcacttttccaggcagctgcgcgctgttccattttttgtagctaaactcattattactgaggatcagctcccctctgtcggcgatgccgaccggcggaacgcgctgattgttctcaaagcgatgggcagaggccatcaatggcaggagcaggcaggtggctgccagcagggtgcgtagggtcatgaggtttccttctgtattattgtttgcaggtgatccgaccacttggtcttaacatttttaatcataagtgcgatcaagggtgttttcccgcaatcccggtgccactttgcggcgtaacgcacacatctgtaaaaaaacgacgacttatactgcctctgattaagcatggaaaagaatattctgattaattgtcatgaaacggtaaataacctgctgcaaactgggtaacaggtggtttgtgatctatagtcattgggcaacaaaatttgcgttcataacagtcggtccgattgtggtaccgcaagggcgtagactcagcagaagagagacaacaatgaaaattttccaacgttacaacccgcttcaggtagcaaaatacgtaaaaatcctgtttcgtggacggttgtacatcaaggacgtcggggctttcgagtttgataagggtaagatcctgctgccgaaagtaaaagacaaacagcattactccgtaatgtctgaagttaaccgccaggtactgcgtttgcagtctgatttggcgtaatcgatgtgctatgcagtcgtttaaataacgaaaatgcaaacggcccctgaaggggccgttgatgtttctggctcaggtaaaagttacgccgcgcctttctcactgccatccggcattttcggcaccagcaccgttggcttgctgtcgatacgcgtcaccagcagctgatcgatgcggaagttatcaatatccaccacttcgaacttaaagccgttgaatttcaccgagtcggtgcgtttcgggattttacgcagcatgaacatcataaaaccgccgatggtttcatagttgccggactgcgggaactcgtcgatatccagtacgcgcatcacgtcgtcaatcggcgtaccgccgtcaatcagccatgagttttcatcgcgcgccacgatctgctcttcctgaccctggcccaccagatcgcccatcagcgtggtcatcacatcgttcagcgtgataatgcccaccaccagcgcgtattcattcatgatcaccgcgaagtcttcacccgccgctttgaaactttccagcgcttccgaaagcgtcagcgtatccggcacgatcagggtgttgcggatctgcacgccgttcaccagcgtcaggctctggttgccaattacacggttcagcagatccttggaatccacatagccgatgatatggtcaatatcttcattacagacgaggaatttggagtgcggatgctgcgccactttattcttcaggctctgctcatcttcatgcaaatcgaaccagatgatgttctcgcgcgaggtcattgacgacggcacggtacgggattccagttcaaaaacgttctcgataagctcgtgctcctgcttacgcagtacgcccgccagcgcgcccgcttccaccaccgcataaatatcgtcggaggtgatgtcgtctttgcgcaccatcggcagtttgaaaatgcggaaaatcacgtttgccaggccattaaagaaccacaccagtggggtgaagataaacaggcagaagcgcatcgggttgatgatgcgcaaagccaccgcttctggcgcaatcataccgatgcgtttcggagtgagatccgcaaacaggatgaacatactggtaacaagggtgaaggagatcataaagctcagctgatccgccagctccggtgacatgaagttgatcagcacgctgtagaaggccggggagaatgccgcatcgcccacgataccgccgagaatggcgaccgcgttaaggccgatttgcaccaccgtaaagaacatacccggcgtttcctgcattttcaggatgcgcatggcattgatattgccctcatcggccagcagcttaagtttaattttacgggacgccgcgagcgaaatctccgacagcgagaaaaacgcactcacagcgatcagacagagtattagtaaaatactgtttaacatatcttatccagccataggccagatcctcgaaagggggaaggttgaaaatctatgtggtaaagctaagtaaaagcgggccgtggaaggttgacccgcaatttcagggggtagtatagcctaaggcagcgttgggttgccagaacgggcttggtcagtaatacaccgccttcattgcgccaggcttatccattgccggatctgcgaggagcggtagatcgcctcgactatcgcctgcgcgcaggcggcatcctcaagggagatatgcacaggccgtgtgggatcgcgcacggtggcataaaactgctggatcgcccgccggtggccatcgccccagtagtttctggcttcgccgtctggcggggtatcctgcgccagcagcgtgcgaacattgtcggtaatgcgccagagctgattttcctccagccgtaagcgtccccgttcgccgtcaatttcaagggaaagcgcggcatctgctgagtagcaggtggtggcatggaacacgccatacgccccgccgctaaattccagcgtcgccatcgcgctgtcttctgtctcgatcaccccgcttaataaggtgctgtcgaccacgccttttacccgcgtcacgccgcccgcgaaccactgcatcagatcgagggtgtgaatcgcctgattgatcagcaggctgccgccctcggtggcaaagcgtccgcgccagccgccaggcctgtagtaatcaccgccgcgcgaccacgtcaggctggccttcatgccccgcagctggccgatgccgccatccgccagctgcgcccggatcgcctggctggtggggttatagcgattctgaaagcacaggccgagcacgcccttagcaccggcagccgcttcccggatctgcgccacctctgccagcgacaggccgaccggcttttcgctgaacacctgctttccggcggcaagcgccgcgatgatcatctcccggtgcagatggtgcggggtacagatatgcaccgcgtcgatgttcatgtccgtgagcatctcgcgataatcctgataaaaacggcagccgtagcggcgggccagcgccgcgcctttttccgcgtcgatgtccaccagcgcgtgcaggctcaccccgggcgtatgttgcagcgccgccacgtggcagccatggatcgcccccgcgccaatgatggcgacgttaagcctgtccatttacgcctccggctgacgggcgtttgccagcatttgcgcccgcacgcacagctctgccgctttgaacgcgtgagcctgggtcatggcgttttcggtgcggtgcagacagtcgagtatcagcgcgccaaaataggggaagccaatttttccggcgacgggataacggaattcgcccgcctgattcaccagatagaccacgtcctgctcgccgcgcgacaggtcgatgtatttgcggatctcgatataaccttcggtgccgagcagcgtcaggcggccgtcgccccaggtggacagcccgtccggcgtgaaccagtcacagcggaaatagccgctcgcgccgttctcccccgccagcatggcatcgccaaaatcttcaaaggtgggatactgcggatggttaacattgcgcacctggcttgccaggatgcgcgcgtcctggttgccggtataaaacagaaactgttcgatctgatggctgccgatgtcgcagagaataccgccataatagcggcgatcgtagaaccagtccgggcggccgtggccttcgcggtgcggcccagtgccgagcgtctggatcacccgaccaatcgccccctgcgccaccagttgtccggcaaagaccgcgctttccacatgcagccgctcgctgtagtagaccgcgtatttgcgcccggttttcgccaccatcgccttcgcgtccgccagctgttccaggctgataagcggcgctttgtcggtgaaataatcttttccggcggccattaccttaagccccagcgggcagcgttccgacggaaccgccgctgccgccaccagcttcaccccgggatcgcgcagaataacctccagcgaggcggccgcctgcgcctgcggatactgttcgaggaatttttccaccctggccgcgtccgcatcataaacccatttcagggtcgcgcccgcctccgtcagaccgttgcacataccgtaaatatgcccgtgatcgagcgccacggcggcaaaaacaaattccccgctgcccactaccggctgcggtttgcccgtcggggcataatgcattccatcctgtttgttcatctttgtgtcctttggcaatcaccaggtaccggaagcgtccagggtgcggttttcaacgtttttctctgccgattgcgcgatgcgctcctgtaacagttgcagatagcgcgcttcgtccagcggcagttcaacccagtcgtccgtccaggtggagaggtgcatggcgttagagagcgtcaggccgtggatgccttcgcagcctggcgcgatcagcggctcgccgcgcagaatagcggcggtgaagttggcggtaataacctgatgatcgctgcacggcgcggcgacggggagggtgacttgccagcattccggctcgccaaaaccgtgctgccagcgggcattgaagtccggttcggattcgcgcagacgccagaagcgtaaagcgccgtcttccaccacaactttgccgcgatcgcctgcgatctccaggcgattagtccccggcgtttcggcgacgctggtaataaacacgcccgttgcgccgttggcgtattcggcgtaggcggtgacctcatcttccacttcaatctgccggcgcttgccgaagtgacagaacgcccgcaggcgtaccggcatgcccaccagccactgccagagatcgagctgatgcggatcctgattcagcagcacgccgccgccttcacctttccacgtcgcccgccagccgccggagttgtagtaactctgcgagcgataccagttggtgatgatccaggtcgagcggcgaatttctcccagctcgccgctgacaatcaggtccttcactttctgataaagcggcgtcgggcgctggttgtacatgatgccgaacaccacatcgcactcgcgcgcgcaggcgttcatctcccgcacctgagcggtgtagacgcccgccggtttctcgcacagcgtatggataccctggcgcatcgccagcatcgacagccggggatgatcgtagtgcggcgtggcgacgatcaccgcgtcgataagcccgctttgcagcatcgcccgggcgtcatcaaacagcggcacggcctcgcccaccagcgcgcgtatcgccgcatgtttcgcagaattattatcgcagacggcggcaaggcaggcgtcgccgatttttccggccagcagatagcgggcgtgcaccgtgccgatattgccgatgccgataatgccaaaacgaacctttttcattgctcacctttggggatcagtgggaataacgggaaaatagagacgcggcaaaccggcgacaaacacaatttgtgagaatgctcgcagggaggcgaggaaactgcgcggcactctgaaaaagggttttaaaatcatcatactggcgctgcaaaaatttgcaggtattgattgcgagcaggatcacactatggcaggaaagctgaaaatggacgccattgccgcacagacgggctactccgtcagcaccgtctcgcgggtattaagcggcaaagccgccaccagcgcgaaagcgcgtgagacgattgtcagctgcgcgcggcggcttggcgtgctcgatgcgctggcatgcggccgtctgctgatcaacgacattgccgtcttcgccccggcacgcactttcagcatgggtggcgatcccttttatcatgcggtgacgcgcggtattgccggggccaccgccgcccatgatgttcacctgagctattgcagcctggaggagcaggacgccgatctggcgcgctttctggcaaaagcgggccacaaaaatatcagcgcgctgatcattatcggcatcgacgatccggcggttcaccggctggcgcagacgctcggtaaaccctgtgtgctgatcaacgccagtaaccgtgaaagccgcctcgacgcggtgtcgccggatcaccgcgccatcggttttaacgccgcgcggcatctgctggcccacgggcaccggcgcattctcaccatcaccaccctgcggcgcgaaaccctgtctgtgcggctggaaggcatcctggaggcgtaccgtcattttcatgtggcctttgaggcggcaacggatctgctggtgacggaaggctttggcggcgacgaggccgcccaacggctggcgcagtggttcgacgcccggcctgcggatcagtggccgcaggcgctgctgtgcggcagcgccgatatgacggcgggtattcagcggatgctggcgcagcgcgggctgcgggtaccgcaggatgtgtcgcttatcagcacggatgtggaagggcaactggacggcagcgtgaccggtattgcggtgccctgccgtgagctgggcgtggaggcggtgcatatgttacagacgcggcttaaccgcccgcaggccccggtgtttaatctgctgctaccggggcggctggtggagttcgggacggtcagccaggcgacccgccatgcagcgcaggccttcccctcaccctaaccctctccccagggagagggactggctcgttctcgatctcccgtcaggagaggggactggctcgttctcgatctcccgccaggagaggggactggctcgatctccctctcccgccgggagagggccggggtgaggggagacgattacgccgtgccctgcggtggcagacagacgccgataccaccgataccgcagtagccgtacgggtttttatgcagatactgctgatggtcatcttccgcatagtaaaacggcccggcggtcttgatttcggtggtgaccgtacggtcatcccccgctgcgcgcatggcggcctggaaacgctcaaggctggctttcgccgcggcgtcctgttccggcgtcagggggtaaatcgccgagcggtactgggtgccgtggtcattgccctgacgcatcccctgagcgggatcgtgattttcccagaacacctgcaacagctgttcatagctgataacgttcggatcgtagaccacgcgcacggcttcggcatggccggtctgaccgctgcacacttcgcggtaggtcgggttcggcgtgtaaccgcccatatagcctgcggcggtgctgtaaacgccgggtaaaacccagaacaaacgttcaacgccccagaagcagcccatggcgaaaaatgcgacgtccatcccgtccgggacatgcgtcatcgagtgttcattgaccgcatgcagactggcaaccggcatcggcgtgttacggcccggcagtgcatccgactgagtaacaaggtgttttttatcaaatagactcacggtgtggcctccggggaaagggaattgtggttagggttgtaacggcgctcgtcttttaacacaataagtgctttaaatacggctaaatttaaacataagaaatattgaggttgtcgtctgtttttcaacccgcattgttgaattattgttaagccgggagcggcattttggtttccttccagggccaggacaaggatattcaggagagaacgtgccacagatccgtcttataggtattgccactttactgctggcaagcggtcacgcctttgcggcaaacgtccgtttgcaggtagaggggttatcaggcgcgctacaaaaaaacgtccgcgcacagctgtcgacgattgaaagcgatgaggtcacccccgatcgccgctttcgcgctcgcgtggatgacgccatccgtgacggtctgaaagcgcttggctactacgagccgaccattgaatttgatctgcgcccgccgccggccaaaggccgccaggtgctgatcgcccgcgtatcgccgggcgaaccggtgcgtatcggcggtacggatgtgatcctgcgcggcggcgcccgcaccgatcatgactatctcgacctgctgaaaacccgtccggctaccggcaccgtactgaatcatcacgattacgacagctttaaaaaatccctcaccaacgttgccctgcgcaaaggctatttcgacagcaagtttaataaaagccagctgggcgtcgccctcgatcgccatcaggcgttctgggatattgattacgacagcggcacgcgctaccgctttggtgaagtgactttcgaaggctcgcaaattcgcgatgagtacctgcaaaatctggtgccctttaaggagggcgattactaccagaccaaagacctggcagagctgaaccggcgtctgtccgccaccggctggtttaactcggtgatcgtcgcgccggaatttgaaaagtcgcgcaaaaccaaagtgctgccgctgcatggcgtggtatcgccgcgaacggaaaacaccattgaaaccggcgtgggttactccaccgacgtcgggccgcgggtgaaggcgtcgtggaaaaagccgtggatgaactcttacggccacagcctgatcaccaacgccagtatttccgccccggaacagcaactggatttcagctacaaagtaccgctgctgaaaaatccgctggagcagtattacctggtgcagggcggccttaagcgcaccgatctgaacgatacggaagcggattccaccacgctggcggtgtcccgctactgggatctctccagcggctggcagcgcgccattaacctgcgctggagtctcgatcactttacccagggcaacgttaccaacactaccatgctgctctatccgggcgtgatgatcagccgtacccgctcgcgcggcggcctgatgccgacctggggcgactcccagcgctactccattgattactccaacaccgcatggggctcggacgtcgatttctcggtgttgcaggcgcagaacgtctggatccgtacccttgccgatcgccatcgctttgtggcgcgcggcaacctcggctggatcgagaccggcgatttcgacaaagtgccgccggatctgcgcttcttcgccgggggcgatcgcagcatccgcggttataaatacaaatccatttcgccgaaggatgacgacggcaagctgaaaggggcgtcgaaactggcgaccggctcgctggagtaccagtacaacgtcaccgggaaatggtggggcgcgaccttcatcgacagcggcgaagcggtgagcgacattcgccgcagcgatttcaaaaccggcgcgggcgtcggcgtacgctggcagtcgccggtcggccccattaagctcgatctcgccgtgcccatcggcgacaaagacgaacacggattacagttttacatcggtctggggcctgaattatgagtttgtggaagaaaataagcctcggcgtactgatcttcatcctgctgctgctgggcaccgtcgcctttctggtgggcaccactaccggcctgcatacgctgtttaaagcggcgaatcgctgggtgccagggctggaaattggccaggtcaccggcggctggcgcgatctgcatctgaaaaatcttagctacacccagcctggcgtggcggttaacgccggggatattcatctggcggtaaagctcggctgcctgcgtgacttcagcctgtgcgttaacgatctgtcgctgaaagacatcaacgtggcgatagacagcaagaaaatgccgaagtcggaacaggtggaagaagaggataccggcccgctggatctctccacgccttacgccatcaccttaagccgcgtggcgctcaataacatcaacattaaaatcgacgacaccaccgtgtcggtgatcgaattcaccagcgggctgaactggcaggagaaaaacctgacgctgaagccaacgaatttgcagggcctgctgatcgcgctgccgaaagtggcggaggtggcgcaggaagaagtggtggatccgaagatcaataaccctcacccggacgaaaagccgctgggtgaaaccctgaaagatctgttctcaaagccggtgctaccggagatgaccgatgtgcacctgccgctgaatctcaatatcgaggagtttcgcggcgaatccctgcgtctgaccggcgataccgatattctggtgcgcaccatgctgctgaaagtcagcacgcaggacggcaacatggcgcttgatgcgctggatatcgactcgaaccagggcacggtgaacgccaccggtacggcgcagctcagcaataactggccggtggatctgacgctgaacagcacgctgaacgtcgatccgctgaaaggcgaaaaagtgaagctcaaggtcggcggcgcgctgcgtgaaaccctcgatgtcggcatcaatctttccggtccggtggatatggtactgcgcgcgcaaactcagctcgccgaagcgggtctgcccctgaatctggaagtggtgagcgaacagctgtactggccctttaccggcgagcggcagtatcaggccgacgatctgaagctgaagctcagcggcaaaatgaccgattacaccctgtcgttccgcacggcggtcaaagggcagagcgtaccgcccgccaccatcctgctggatgcgaagggcaatgagcagcagatcaatctcgacaagctgaccgtcgcggcgctggaggggaaaaccgagctgaaagcgctgctcgactggcagcaggcgatcagctggcgcggcgatctgacgctcaacggcatcaataccgccaaagaattcccggactggccgtcaaaactgaacggcgcgatcaaaacccgcggtagcctgtacggcggcagctggcagatggatgtcccgcagctgaagatcaccggcaacgttaaacaaaacaaagtgaatgtggaaggctccctgaaagggaacagctatctgcaatgggtgatcccaggtctgcatctgcaactggggccgaacagcgccgacgtcaaaggcgagctgggcgttaaagatcttaaccttgatgcggtgataaacgcgccggggctggataacgcgctgccgggtctgggcggcacggcgaaaggcctggtgaaagtgcgcggcaccgtcgatgcgccgcaggtgctggcggatattaccgcccgtgcgctgcgctggcaggagctgtcggtcgccagcgtgcgtgtggatggcgatgtgaaatccaccgatcagatcgccggtcacctcaacgtgcgcgccgagcgcattgcgcagccgggcgttaacctgagcctggtacagctggatgcaaaaggcagcgaaaaacagcacgagctgcaactgcgtgtgcagggcgagccggtatccggccagcttaaactggcgggcagctttgaccgcgccacccagcgctggaaaggcaatctgagcgacacccgcttcgccaccccggtcggcccctggtccctcaaccgggcgattgcgctggattaccgtaacagcgagcagaagatcagcatcgggccgcactgctggactaacccgaatgcagaactgtgcgtaccgcaaactatcgatgccggggccgaagggcgcgcggtggtgaaccttaaccgcttcgatctggcgatggtaaaaccctttatgccggacgccacccaggccagcggcattttcagcggcaaagccgacgtcagctgggatacaacgaaagagggcctgccgcagggggaagtgaccctctccgggcgcaacgtgcgcgtgacgcaaaccatcaacgacgcgccgctgctggtggccttcgacacgcttaaccttaacgcgcggctgcgggataaccgcgccgatctcggctggatgatgcggctgaccaataacggtcagtttgatggccaggtgcagatcaccgatccgcaggggcggcgtaatctgggcggcaacgttaatatccgcaacttctctatcggcatggtcaacgccatcttctcgcgcggcgaaaaagcggcgggcacgctgagcgccaacctgcgtctggccggggatgcgcaaagcccgcagctcttcgggcagatgcagctgaacggcgtggatatcgacggcaactttatgccgttcgacatgcagccgagccagctggcgatgaacttcaacggccagcgctccacattgcagggcgtcgtgcgcacccagcaggggcagatcaacctcagcggcgatgcggactggagccagctggataactggcgcgcgcgggttgccgccaaaggcagcaaagtacgcatcaccgtaccgccgatgatccgcctggatgcctcgccggacgtggtgtttgtcgccacgccggatctgttcaccctcgacggcagcattgatattccgtgggcgcgcatcgtggtgcacgacgtgccggagagcgcggtcggcgtatccagcgacgaagtgatgctcaatgccaacctggagccggagaaaccgcagtccgccagcatcccgatcaacagtaacctgatcgtgcatgtgggcaataacgtgcgtatggacgcctttggcctgaaagcgcgtctgaacggcgatttaaaagttgcgcaggataatcaagggcttggcctgaacgggcaaataaatatccctgaaggacgcttccatgcctacggtcaggatttgattgtgcgcaaaggtgagttattgttctcgggcccaccggatcaacctttacttaacattgaagcgatccgtaaccccgaggccaccgaaaacgacgttatcgcaggcgtacgggtgacaggtaccgccgatgaacctaaggcggagatcttctccgacccggcgatgtcgcagcaggaagcgctctcctatttactacgcggacagccgctcgacagcgatcagagcgacagcgcggcgatgacctcggcccttgttggcctgggggttgcacaaagtgggcaggttgtgggtaaaatcggcgagacgttcggcgtcagcaatctggcactggatactgccggggtgggggactcctcccaggtggtggtcagcggctatgtactgccgggtctgcaggtgaagtatggagtgggtatttttgattctctggcaacgctcacgctgcgctatcgcctgatgcctaagctttatctcgaagcggtgtctggcatagatcaggcacttgatttgctctatcagtttgagttttagcaatgcgaatatttgtctacggcagtttacgacgcaagcaaggcaacagccactggatgaccaacgctcagtggctgggcgatcataatgttgaagattttcgactgtacagtctgggtcactaccctggcgcggtgcccggtgcgggccatgtgcagggggaagtctatcgtatcgattcggcgacccttgccgaactggatgcattacgcaccgcaggcggtgagtataaacgtcagttgatccagacaccgtacggcagtgcatggatgtacgtgtaccagcgtccggtcgacgggcgcacctggattgaaacgggaaactggctggatcgggaccggtattaatacaacgccaccttcgggtggcgttgttttttgtggattgactaaggcgcaggggtgattttcagctccaccagccctatccccagcctgcgctgaagagtttctgccagcgtgacgccacggccttcctcatcaacaggctcgctgtcgggcggcgtgatgatcagttcagtcggaccgccggtcgcggaaaagcgtaccgttcgggtggaaatttcactaccaaataccaggctatgttcttcttgtccggcgcgcacaagaatctttttcccgatgttagcggcagaggctttggctaccagggtaaggtcaaaggcgtccggcaagggacgtttataaaccacggttaccgccgggtcgatattggcattcgaccagcgtccccagtcctcctgccacgaaatcccccgcaccgccttcacctgttgggggaacccttcaatgtcgaacatgatgcgatccgccggataacgcacactgtctggcgtctgattaaggcttttcacccgctgatgaatgtccacgcgatcatcgtcgtgctgcggaaatgccactctggtctgataaaccggcgtcgggattctccgcacgctcaccgccgactccagcgtgccttccgctaagcagagttcccgtgcggtcgccagctcaggcttccccaggcgggcaatgcgaaagcacttatcgatccacacaaagcgatcctctgccccgaaatgggcaaggtatttactcagcggcgcgttataggtgcccggaagatagggctgcacgctgtcttccgttaccttgaagagcaccggcagggtgtagttaaaatcgcccagcgacaggctgccgctctgctgattaatcactaactggtcaatcttttgcggatcgcccgaccataaacgaataatatccggctcccagtccagcagacgcgtttcaagggatgtataggtggcggacagggagggacgtgaaagggtactgcggccaagcccgatggcgttatcgccgccgagtaattccagcacggtggccccgttatccatcgtattacgtggccgggaaataaccttcgtctgtgaacgatcgccgcgcagaataaaaaacaaattttcccgctgcggttgtttttgcgcaatctgaccgccgatgggctccatcgccagatgatcggaggacaccacgatcagcgtatttttaaagccaggcgacgctttgatcttattaatcagcgtggcgatattttcctggctgcacagcacggcgttgaacgcctcgtctttgccctcctgccagcgtttttgctgacagcttttcgcaatggatcccaccggcggatgcgtatccacggttaaagcaaagagcgcgaaaggcttattttgcgcggtaagcgtctggtatttctcccagaccgcattaagagtggtgtcatcgtgcagaccccagtcattgaggtacgtcttatccggcagcgcgtctttttgctcctgcaatccgtcgacatgctgaaagccatgcgtgttaaaaaacgccgctttactggcaaaacgcagatccgcgccctgataaaagtaattgtcataacctgagtttttaagaatatcgccaagacatatcagcgagggaaaaaaactgcgcaggttatcagagaaattacgatccataggggagaagaagggaataccgcactgcgaggcgacaataccgccaatggtaaaatctgtccccggtaattgcctggtgtcagaaaaatctaatgaagattttctgataagatttaaatcgggaaccagccgtgggaatttattttcgtcaaacaaggtccgctcaagactttccgcataaatatacaccaggttataagcgggattatttatcttcgtggctggtttaattaaatattcaggaaagtcagaattagctttacggtaccgggaataagcaatatccgcaagctggccggtggcaggcatcaggctgattgccgccactattaatagcatcgccacacacatcaggcctttgtgcccggcatgaccggtggcgcgcataaacaaccagcccagtaacagcatactgacgatcatacaggcggccagtcctgcggcgggtaacagatactgggcgatcccggcgccggtcaggttatccgtcagcgtataaacggcggcgcggttaatgccggcgccggtaaaataattacagccgaaatataaaatattaagcagcagataaatgagcgaaccgaccatcgttgcccgacgccagcctttttgctgtcctgcggtgcgcaggaagaggatcagccctgtaaaaaacaggacgaaatgcaaataactgttcaaagccaactccatttagctcagattatccccaaaatccgggatacagcaatactgatatatttagttaatgaataaaaaaacggaccctgctgttggcgggtccgttgatagtaatactttaaataaacccgctatacggaattatttcttcgctgcgcgctcgaaagaggccacgatttcagctttagccgcttcggcgttgtcccagccgtccactttcacccatttgcctttttcgagatctttgtagtgctcgaagaagtgagtgatctgcgctttcagcagttccggcaggtcgttcacatctttgatgtgatcgtattctttgctcagtttagtgtgcggaaccgcaaccagcttggcgtcttcgcccgcttcgtcggtcattttcagcacgccaaccggacggcagcgtacaacagagcctggctgtaacgggtacggcgtcggtaccagcacgtctaccgggtcgccgtccagagacagggtgttgttgatgtagccgtagttgcacggatagaacattgcagtcgacatgaagcggtcaacaaaaagcgcgccggtgtctttgtcgatttcgtatttgatcggatcggcattggccgggatctcgataacaacgtagatgtcttctggcagatctttgccggcaggtacgttcaataagctcatgtttgtttcctttaaaatgtgtgcaaacaagtgccgggtattatagctaactccctgggaaagtctctggctgttttcagccgtgtcgtctgttgataacggattcaggagcaatctgacgcgcggattgtccataaagttagctgcatactgaataaatttgtggaagcgtttacacagcgcgatttgcgacaccgtaaaacgcaaaaattccgcaaatgccaggtatgtcataggtctgttaaaacatcacttttcgcgcgctggatctcatctggttgttaacctttcgttcacttttctgaagtgtgatgtaacgcattctgttacatctctggttgtctatagtgtccgggcaggtgaagttatagccaacaataaccctacgaggatgtccctatgtggaagcgcttacttcttgtcacagcagtttcggcagccatgtcgtctatggcgatggccgcacccttaaccgtcggtttttcgcaggtcggatctgaatccggctggcgcgccgcagaaaccagcgttgcgaaaagcgaagcggaaaagcgtggaattaccctgaaaattgccgatggtcagcaaaaacaggagaaccagatcaaagccgttcgttcctttattgcccagggcgtggatgcgatctttatcgcgcctgtggtggcgacaggctgggagccggtcctgaaagaagcgaaagaggcggagatcccggtcttcctgcttgaccgtaatattgatgtgaaagataagtcgctctacatgaccacagtgaccgccgacaacgtactggaaggccgcttgatcggcgaatggctggcgaaaaccgtcggcgacaaacagtgtaacgtcgtggagttgcagggcaccgttggcgcaagcgtagccatcgaccgtaagaaaggtttcgccgaggcgatcagcaaaacgtcgaatatcaaaatcatccgttcccagtccggcgacttcacccgcagtaaagggaaagaggtcatggaaagcttcatcaaggcggaaaacaacggcaaaaatatctgcatggtttacgcccataacgacgacatggcgatcggcgcgatccaggcgatcaaagaagcgggcctcaaaccgggcaaagacattctgaccggctccatcgacggcgtgccggatatttataaagcgatgatcgacggcgaagccaacgccagcgttgagctgacgccgaacatggccggcccggccttcgatgcgctggaaaaattcaaaaaagacggcacgcagccggaaaaagtcaccatcaccaaatcgacgctctacctgccggataccgcgaaagaagagttagagaagaagaaaaacatgggctactaagcctttaacctgccgggtgacgctgcgcttactgacctgagacgtgcttttacaggccggtaagcgtagcgccatccggtttgacgcagggggaaccatgaccacagaacaacaccaggaaatcctccggacagagggcttaagcaaattcttccccggcgtgaaggcgctggataacgtcgatttcagcctcaggcgcggcgaaatcatggcgctgctcggtgaaaacggcgcgggaaaatcgacgctgattaaggcgctgaccggggtctatcacgccgatcgcggcgctatttatctggaaggcgaacgcatcgcgcccaaaaataccgcccatgcccagcaactggggatcggcaccgtttatcaggaagtgaacctgctgccgaacatgtcggtggcggataacctgtttattggccgcgaaccccggcgattcggttttttgcgccgtaaagagatggaaaaacgcgccaccgcactgatggagtcctacggcttctccctcgacgtgcgtgaaccgctgaaccggttttccgtggcgatgcagcagatcgtcgccatttgccgcgccatcgatctctcggcaaaagtgctgatccttgatgaacctaccgccagcctggatacccaggaagtggagatgctgtttaccctgatgcgtcagttgcgcgaccagggcgtgagcctggtttttgtcactcactttctcgatcaggtgtatgaggtcagcgaccgcatcaccgtactgcgcaacggcagctttgtcggctgcaaagaaacgcgcgagctgccgcaaatcgagctggtcaaaatgatgcttggccgcgagctggataacaacgcgctgcaacgcgccgggcgcacgctgctcagcgacagaccggtcgccgcattcaaagactttggtaaaaaaggcgttattgctcccttcgatctggaggttcgcccgggtgagatcgttggcctggcgggactgttaggctccggacgcaccgaaaccgccgaggtgatcttcggtatcaaacccgccgatcagggcaccgcgctgatcaagggcaaaccgcaaacgctgcgctcgccgcatcaggcttcctgcctcggcatcggtttttgccctgaagaccgcaaaaccgacggcattatcgccgccgcctcggtgcgggagaatatcattctggcgctacaggcccagcgcggctggctgcggccgatcccgcgcaaagagcagaacgagatcgcggcgcgctttattcgccagctggggatccgcacaccgagtgcagagcagccgattgaatttctctccggcggcaatcagcaaaaagtgctgctctcccgctggctgctgacgcggccgcagttcctcatcctcgacgaaccgacgcgcggcattgacgtgggggcccacgccgagatcatccgccttatcgaaaccctctgcgccgacggcctggcgctgctggtcatctcctccgaactggaagaactggtcggctatgccgatcgggtgatcatcatgcgcgatcgcaaacagatcgcggagatcccgctggcggaacttaccgtgccggcgatcatgaacgccattgcggcctaaggagaagcatgtgatgcctcaatctctgccccgcgcgggggaacctaaacgccgcttcagctggccggtggggacgccgcaaattattgcgctgttactggtgctggtggtcgacagcctggtcgcgccgcacttttatcaggtgattttgcaggatggccgcctgttcggcagcccgatcgacattcttaaccgcgccgcgcccgttgcgctgctggcgattggtatgacgctggtgatcgccaccggcggcatcgatctttccgtcggcgcggtgatggccatcgctggcgcgacggcggcctcaatgaccgtcgccggacacagcctgccggtggtgatactggctgcgctgggatccggcgtgctggcgggattgtggaatggcgtgctggtggcaatcttaaagatccagccctttgtcgccacgctgatcctgatggtcgccggacgcggcgtggcgcagctcatcacctccgggcagatcgtcacttttgacgcgcccagcctgtcgtggcttggcagcggctcgctgctgctgtttccgacgccggtgatgattgcgctgttaacgcttatcctgttctggctgttcacccgtaaaacggcgctcggcatgtttatcgaagcggtggggatcaacatccgcgcggcgaaaaacgctggcgtgaatacccgtatggtggtgatgctgacctacgtgctgagcggcctgtgcgcggccattgccggtattatcgtcaccgccgatattcgcggggccgatgcgaataacgccgggctgtggctggagctggacgctattctggcggtagtgatcggcggcgcgtcgctgatgggcggacgctttaatctgctgctgtcggtggtgggggcgctgatcatccaggggatgaataccggcatcctgctctccggcttcccggctgaactcaaccaggtggtgaaagccgtcgtggtgctgtgcgtgctgattgtccagtcgccgcgctttatttccttcattaaacggagccgtggtcatgatcaaacgtaacttaccgctgatgatcacgcttggcgtgttcgtgctcggctatctgtattgcctgacgcaatttcccggctttgcctccacgcgggtgatctgcaacatcctgacggataacgcctttctcggcattatcgccgtcggcatgacctttgtgatcctctccggcggtatcgatctgtcggtcggttcggtgatcgcctttaccggcgtcttccttgccaaagcgatcggcttctggggcatctcgccgctggtggccttcccgctggtgctggcgatgggctgcgcctttggcgcttttatggggcttttaatcgacgggcttaaaatcccggcctttattatcaccctggcgggaatgttctttctgcgcggcgtcagctatctggtgtctgaagaatccattcccattaaccacccggtgtacgacacgctttcaagcctggcgtggaaaatccccggcggcgggcggctcagcgccatggggctgctgatgctcggcgtggtggtgatcggcattttcctcgcgcaccgcacgcgctttggcaatcaggtgtacgccatcggcggcagcgccacctcggcgaatctgatgggggtgtccacgcgcagtaccactattcgtatttatatgctctctaccggtcttgcaaccctcgcaggtattgtcttctcggtttacacccaggcaggctatgcgctggcaggggtcggcgtggagctggacgccatcgcgtcggtggtgattggcggcacgctgttaagcggcggcgtcggcacggtactggggacgctgttcggcgtggccattcaggggctgatccagacctatatcaactttgacggcacgctcagctcctggtggacgaagatcgccatcggcatcctgctgtttatttttatcgcgttacagcgcggcctgaccgtcctttgggagaatcgccagagctcgccggtaacacgtatcagcacggcggcaacaaagccataacgcactgaattggttaaaaaacgttaaagattttccggtggcagccgataactcaaaattacgctctgtttgcgccacgaagtatccctgctaccggaatcatcatcatgctaaaaacgctatcgattcgcaccggcttgctgtctttactggccgttatgacattactcctgctgctggtcagcggcatcgggatttacgccctcacgcaaagttcctcctctctgcaacgcatcaatcaccttcagggtgagcagatggcgcgtctgaatgaaggatataacctgattttacgcgcccgcaacgaggccggtcaggctgtacgcatgatggaagtcgggctgctggacgatgccgggaaatccgtcaaagggatcaacagcgaaatcgcgcaggcgcagaaaggcctgcaggcggtaatcgatgcgggcgtggatgacgaagccggtaaaccgctgctggatcgtctggcgaaaagctatgccgactacaatagccagggcatcgtgccgatgcagaaagcgctgaacgagcaaagccccgacggctattacgatctgctggaaaacaagctgattccggtgtcgcgtcagtttgataacgacatgcaggcattcctgaaatggggcgaaacccgcggtcaggcggaagtgaaggcggtgcaaagcagtaaaaaccgcgtcatggtgtttatcgtcattgccgcgctgttgacggcgggcgtcatcgtgctggcgtggctggtgctgcgtcatatgctgttaaaaccgctggatgcgtcaatccgtcaactggagcaggtggccgcaggcgatctcacgccggtcagcgccgcgcccgccagcaaggagttcaaccgcctgatcgccgccattgatgagatgcgccattccctggtgggatcggtcacccgcgtgcgcgatgccagcgcgcaaattgataccggcagccgcgagctgaccgccggcaatatggatctggcgcagcgcaccgaatccaccgccagctcccttgagcagacggcggcgagcatggaagagatcaccgccacggtgaaacaaaacgcggacaacgccgaacaggcgcaccagctggcgaaaaccgtctcggataccgccgatcgcggcagcgaaatggtctgctacgtgattgaaaaaatgagcgatatcgccggcagtgccaaccgtatcgccgacatcctcagcgtcattgacggcattgccttccagaccaatatccttgcgctgaacgcctcggtggaagccgcgcgggcaggggagcaggggcgcggttttgcggtggtcgccgcagaagtgcgtaatcttgccggtcgcagcgccgatgccgcgaaagagatccgcaccctgatcagcgattccaaagcgcacgtcagcgaaggcaacgatctggcgatccaggccggggaaaccatggatgaaatcgccggtgaagtgatgcgtatgaccaaactgctgcgtgaaatcgccagcgcctcgcacgagcagagccgcgggattgaacaggtgaatattgcggtcaatcagatggacgagacggcgcagcagaactccgcgctggtgcagcaatcctccgccgcgacccgctcgctggaagagcagtcgcgtgaactgatggaagcgatggcatcgttcagattgcagatggcgggctaagaggctgaattgcccggcacactaatgagtaggccgggtaagcgtcagcgccacccggcgaaccgtatcaacaatctaaaaattacgcgtccggatactcacgcataaagcgctctacgtcattcaccatatgctcgttgccgacgaagaacgggcggcgctggtgcaggctttccggcacgatgtccagaatacgctctttaccgtcgctcgctttaccgccagcctgctctgccaggaacgccatcgggttaccttcatacagcagacgcagcttcccttccgggtggcttgcggtgctcgggtaaaggtagatgccgcctttcagcaggttacggtggaaatccgccaccagcgaaccgatatagcgcgaggtatacgggcgatgggtggcctgatcttcttcctggcagaacttcagatacttcttcacgccctgcgggaatttaatgtagttgccttcgttaatggagtaggtgtaacccttttccgggaagcgcatacgctcctggcacaggcagaagacgcccagagacggatcgtaagtgaaggcatgtacgccgcagccggtggtgtacaccagcatggtggaggagccatacaccacataaccggcggcaacctgcttgttacccggttgcaggaagtcttcttccgttaccggcgtgccgaccggcgtgacgcggcgatagatagagaagatggtcccgacagaaacgttaacgtcgatgttggaagagccgtccagcggatccatcagcaccacgtacttcgcatgctcgcacccttcgaaaaccacgatttcgtcttcttcttcagaggcaatgcccgccacgatgtcgcgtgctttcagtgcagatttcagtttttcattggcgaacaggtcgagtttttgctgcacctctccctggacgttttcggcaccactggcgcccagaatatcaaccagaccggctttgttaatatcccggtggatgattttggcccccagttttatcgccgacaacagtgacgtgagctcacccgtggcatgtgaaaactcatgctgcttttcaacgataaattcacctaacgttttcataacacttccctacattctatgtggagtaaagcgactgcaacaatcttaacaaagtttcaaaagattgcgcacaggtgaatcgcgccagcaaactacggaatatcctgaaatgcatttatctgaccgcggacatgtgggtaaaatgtgcgccagattaaagaaggataacgacgtatgcgcattcatatattggggatttgtggcacctttatgggcggcctggcaatgctggcccgttccctgggccatgaggtaacgggttcggacgccaatgtgtatccgccaatgagcacgcttttatcagaacaagggattgatttaattcagggttacgatccatcgcagctcgataacgcgccggatctggtgatcatcggcaacgccatgacccgcggcaatccgtgtgtggaagcggtgctggaaaagaacattccttatatgtccggcccgcagtggctgcacgatttcgtgctgcgcgaccgctgggtgctggcggtggccggtacacacggtaaaaccaccaccgccggtatggcgacctggatcctcgaagtctgcggctataaacctggctttgtgatcggcggcgtgccgggcaattttgaggtttccgcgcgtctgggtgaaagcccgttcttcgtcatcgaagccgacgaatatgactgcgccttcttcgacaagcgttccaaattcgtgcactactgcccgcgcaccctgatcctcaacaatcttgagttcgatcatgcggatatcttcgacgatctgaaagcgatccagaagcagttccaccacctggtgcgcatcgtgccggggcagggcaaaatcatctggccggaaaacgacatcaatctgaagcagacgatggcgatgggctgctggagcgagcaggagcaggtgggcgagcagggacactggcaggcgaaaaagctgaccaccgatgcttccgaatgggaagtgtggctcgacggcgaaagcgtgggccgcgtgaagtgggatctggtgggcgagcacaacatgcataacggcctgatggcgatcgccgcggcgcgtcatgtgggcgttgcgcctgcggatgcggctaatgcgctgggatcgttcatcaacgcccgccgccgtctggagttgcgcggcgaagccaacggtgtgacggtgtatgacgatttcgcccatcacccgacggcgatccttgccaccctggccgcgctgcgcgggaaagtgggcggcaccgcgcgcattctcgccgtgctggagccgcgctcaaacaccatgaaaatgggtatctgcaaagatgatttagcgccgtcgctgggacgcgccgatgaagtgttcctgcttcagccgcagcatattccatggcaggtggccgaagtggcggaagcctgcattcagcctgcgcactggcatgcggatgtggataccctggcggagatggtggtgaaaaccgcgcagcctggcgatcacattctggtgatgagcaacggcggttttggtggtattcatcagaagctgctggacgggttagcgaagaaagcggcggcggcttccgagccggtgtaatacagcgcccggtggcgcttcgcttaccgggcctacaaaaccatcaaaccgggaaccgtaggccgggtaaggcgcaagccgccacccggcaaaatgttaaccggtgcttactccgcgtcggcttccgccagctcgcgcaggtactggaaaatcagacgcgcagacttcggcgctttattcccttctttctcttttttcgcattgcggatcagcgagcgcagctgctgacggtcggcatgcggccacaggttcagcacgtccggcaccgcatcatcgccttcttcaatcagacggtcgcggatgtgttccagcttatggaaaaacgcaacctgctggttgtggcggtttttcagcttatccagcgcctggcggatcggatccacatcgcgctgacgcagcattttgccgatcaactgcatctggcggcggcggccttctttcttgatacgctgcgccagttcaatggcggcgcgcagatcgtcatccagcggaattttgtcgagggcatttttgcccagctcaaccatctccgcgccgaggcgttttaattcttcggcatcacgcttaatttcacttttactgacccagatgatctcatcatcttcatcatcgatctcatcaccgggctcgtcgtcgagccagtcttcgggctgcttggtcatctcaggctccttaaaaaagaggctaatactaacaccctgggagcacactgagaatgggttctctgttagacttctttgaaactccccttacattatggcattggcgatgaaagtaatcacacaagttgcagagcaacgcaaagcgctggaagaagccgtctccaccgcactgagtttagccgctggcaaatcggatggcgcggaagtgtcagtatcgaagacgaccggcattggcgtgagcacccgttacggtgaggtggagaacgttgaatttaacagcgatggtgcgctgggcatcaccgtttaccatcagaatcgcaaaggcagcgcctcctccaccgacctgagcccggacgccatcgcgcgcaccgtgcaggcggcgctggacattgcgcgctacacctcgccggatccttacgcgggcgtggcggataaagagctgctggcctttgacgcgccggatttagacctcttccacccggcagagatcaccccggacgaggcgattgcctttgccgcgcgcgctgaacaggcctccctcgccgttgataagcgcatcaccaacaccgaaggcggcagcttcaacagccactacggtatccgcgtattcggcaacagccacggcatgctgcaaagctactgctccagccgccattccctctccagcagcgtgattgccgaagaaaatggcgatatggagcgcgattacgcctataccatcgggcgcgcgttagacgatctgcaatccccggaatgggtcggcgcggaatgtgcgaaacgcacgctgtcccgcctgtcgccgcgcaaactctccaccatgaaagcgccggtaatttttgccaatgaagtggcgaccgggctgtttggtcatctggtcggtgccatcgccggcggcgcggtataccgcaaatccaccttcctgctggactacctcggcaaacagatcctgccggaatggctgaccatcaacgagcagccgcatctgcttaaaggccttgcctcgacgccgttcgacagcgaaggcgtacgcacagagcgccgcgaaattatcaaagacggcattctgacccagtggctgctgaccaactattccgcgcgcaagctggggctgaaaagcaccggtcacgcgggcggcattcacaactggcgcatcgacggtcgcggcctcagctttgagcaactgctgaaagagatgggcaccgggctggtggtgaccgagctgatgggccagggcgtaagcggcattaccggcgattactcccgcggcgcggcgggcttctgggtggaaaacggcgaaatccagtatccggtaagcgaaattaccattgcgggcaaccttaaggacatgtggcgcaacatcgttaccattggtgacgatattgaaacacgcagcaatattcagtgtggttcagtgctgttaccggagatgaaaatcgccggtcagtaattatcaataaaaacaaaaaggaagtgagcaatgcgtaaaaacatgctggcgttactggccatatcatccctctttgtaggtcaggcggcgcttgccgatctgggcgatgatatggatacgctgaatgaaaacctgaaagtggtgcagaaaaccgataacgccgatgaaatgaaagacgcgttaacgaaaatgcgcaccgccgcgctggatgcgcagaaagaaacgccgccgaaaatggaagataaagcggcagacagcccggaaatgaaagagtaccgccacggttttgatattctggtgagccagattgacggcgcgatgaagctggcaaacgaaggcaaggtcaaagaagcgcaggccgccgccgaagaaataaaaaccacccgcaatacgtaccacaaaaaattccgttaagcgtatttacccggcctgcacctgcaggtcgggtaagcgaagcgccacccgacatcagctacatccgcccataagcctttctaatacttgccacaaaaaccccgtatatctcacagatcggcattttcttttatgccggacgccgcgcggaacacggcgttataccgtgatgaaactcacactattccagccaaaaatcttctctgccgctttttctgtggaacagatcactgccgccactgacctttccacttcgaagtggaaaacaactcgctacaaactcttaacctgcgccgttagttttaacccggagacattaacggggtaagacgagtgaataacggagcggtaaacaacgacgcggggcgtctggcggacaccatgttaacgcaggtctacagcctgctggcccgccacaacattatccccaacgcggtacaggaacagatgctgacctcgcacgtccgtgccatggcgcaccgttcgataaccggcgaaccactgccggaggtcgatgccagcctgtttgacgagatctcagaagattcaatgtcacttgcccgtgaaatcgtggcggcgtttggcaaccttcccgaagaagaggcctggctgctgtcggtgcacttcgaagtggcgaaagacaacctgtaaggagcaaaagatggaacagattaccgtagtgattggcgatcgcctgggcaaaggtcagaaagtggcagccggtgtggaaaaagcgggtggacgcgccgtggtggtgccgggcgtggcggcagacatgaagctgggcgacgtcatgaaagcggaaaacgccacctttggcatttcattctgcggcagcggcggcgcaggggcgatcaccgcgcagaccaaatatggctacaaagccaaatacggcatgcgttctgtggatgagggcgtcaccgccatcaacgaaggctgcaacgtgctcggcttcggctttatggataaagaagagttaggcgagcgcctggtgctggcgtggcagaaaaagcacggcgcatgagtatgaaagagcatttcaccaccacggtgagagttaacggcaaaggcgagtcgaaatcgcgcgcctttgcggatgccctgaaccaggttcagggcgcggtgatgaaggcatcgccgcatattttactgcgtattgagccacaggatgtgcaggttgttcatgcgcgtgaagcggtgcgcaaagaagcatttctgtttttctttctgcgccgggagcgacgcacgttcagcgtggagctggacgttaccgtcaacgtgaccgccattaatctcgataaagtggcattcgtcacgcacacctgattttcaccatagggtttaactatgttcctgataattttaataaaatctctcatcatcggcggcctggtcggcgtgggtgtgggagccggggctgcacgcatgtttcacgcgccaaccacccagggaatgggggcgtttcgtaccttaggcgagctgaactcctgtgaaggggatccggcgtcgcacttctcctttggactgggctttttcttcaacgcctgggcctcgtccgtagcggcgggatccttcacccaggacgtcgatcatcgcatcatcccgaactggggcgcggcggcgctgatgatcaaaaaccgcaacgtcggcgagacgctgcacgatccgaaaaagatggccattgcctgcggcgtgatcggcatgatcgtcgtcgccttcctcaactccaccgcctcggcggtaccggcggccttacaggtgacggcggtaaaagtgctggtgccggcggcgaacctgctggtgaacaccgtcatgccggtgatcttctggctggcggccattgatgccggtaaaaagtccggcttctgggcgaccattttcggcggcgcggcgcagctgatcatgggtaacgccgtaccgggtctggtgctgggcattctgattggcaagggcgtggaagagagcggctggaaccgcgtcaccaaagtgatgatgagcgccatcgttgcgctgttcgtactgagcgccttcttccgcggcttcgacatgaaaatgatcgaatccttccacctcaccgtgccgaactggctggatctgatccacaacgcggtaagcggcaaataacaggagcctgacatggaacagaataaaggtttttggtacgccgactggtcattcccgatcttcgttggcctgctctcctccggcgtctttgccgggacacacatgtattacctctacggcatcggcgcgtttaacgaagtggcttttgtgtcgatgctgcgggcaggcatggacaccggcgtctacggcgcggtggcggcgttcggcgcgagcttcctgttcgcgcgcatcattgaaggctcgctggtgggtattctcgacatcggcggcgcgatccagaccggcgttggcctgggcgtcccggcgctgctgttaggcgcgggctttgtcttcccggtggcgaactttggcgcatcactggttaccggcctgctgataggcctggcgatcggttacctgatcatcctggcgcgtaaattcaccatcaatcagagcgactccacctacggggcggacgtgatgatgggcgcgggtaacgcttccggacgtttcctcgggccgctgattattctcagcgcaatgaccgcctcgatcccgattggcattggctcgctgattggcgcgctgctgttctacatctggcagaagccgatcaccggcggggcgatcctcggcgcgatgatcctcggctccctcttcccggtcgcgctgtaatcaaactcaaggagatgcgcatgtatgatttactcctgcgccgcgcgcggctggtggacgacactatcgtcgatatcgccgtgcaggacgggcagatcgcggcgattggcgagatcgacgcgccggccgcgaaaatcctcgatctgaacggtgagcactacgtcagcgcgggctggatcgactctcacgttcactgctacagccgttcacccatctaccgcgacgagccggacagcatcggcatcgccaccggcgtcaccacggtggtggacgcgggcagcaccggcgcgaacgacgtggacgatttctatgccctgacgcgcagcgcggtgacggaggtttacgcgctgctcaatatctcccgcgtcgggctgatcgcccagaacgaactggcggacatggcgaatatcgacggcgaggcggtacgggcggcggtaaaacgccacccggactttatcgtcgggctgaaagcgcgcatgagcggcagtgtggtgggcgataacggcatcgcgccgctggagcgcgcccgaacctttcagaaagagaacggcgatctgccgctgatggtgcacatcggcaacaacccgccgaacctcgacgacatcgccgcacggctgacgtcaggcgacatcatcacccactgctacaacggcaagccgaaccgcatcctgacgcctgcgggcgagttgcgcgcctcgatgatcgacgccctgcgccgcggcgtgcgccttgatgtcggccacggcagcgccagcttcagttttgaggtggcgaagcaggccatcagcctcggcattctgccgcataccatcagctcggatatctactgccgcaaccgcattaacggcccggtgttttcgctggcgcgggtaatgtcgaaatttctcgccatcggcatgtcgctgccgcaggtgatcgaatgcgtgaccgccagcgccgccgacggcctgcggctgaaacgcaaaggtcgcctggcggtgggctttgacgccgatctgacgattttcgactggcggcaccagccggtgctgttcaccgacgcagaaaacgacagcctgcatgccgacagcgtgctggtgccgctggcggcgatccgtgcaggtaaaggttatatgacaccacaagggagtgaagaacatgtcttcgatttatgaaaaatacgcgctcaaacaggtgattaacgcctccgggcgcatgaccgcgcttggcgtctccaccccgcgcccggaagtggtcgaggcggtgctaaccggcatgaaccactattttgagatgaaagatctggtgaccaaaaccggggactacatcgcaaaactgctggaagtggaaggtgcgaccgtcgtctcctgcgcttcggcaggcattgcgcagtcggtggcggcggtgctggtcaaagacagcgactggctgctggaaaacctgcacagcacgccgatcgaaaacaacgaaatcgtgctgccgcgcgggcataacgtcaactttggcgcgccggtcggcaccatggtggcgctgggcggcggtaaagtcgttgaagccggttacgcgaacgagtgctcggcggcgcagctggcggcagccatcaccccgcgcacggcggcgatcatgtacatcaaatcgcaccactgcgtgcagaaaagcatgctcaacgtcgaacaggcggcggtggtggcgcgtaaacacaatctgccgctgatcgtcgatgccgccgccgaagaagatttgcagtgctactaccgcgccggggctgatcttgtgatctacagcggggcgaaagctatcgaagggccgaccagcggcctggtgatcggcaaacagcagtatgttgagtgggtgaaacgccagacagcgggcatcgggcgcgccatgaaagtgggcaaagagggcattcttggcctgacctgcgccatcgaacactacctctccgcgcagaaagagagcggcgcagaaatggtggcaaaaatgacgccattcattgacggactgaatacgctggacggcgtcaccgcgcgcgtggtgtgggacagcgccgggcgcgacatcgcgcgggcagagatcaaatttgatgaagccgtcaccggtatcgccaccggcgagctggttaatgcgttgaaacagggcgagtacgccatctatttccgtggctataaagccaacgaaggcattatcgaagcggacgtgcgcagcgtcagcgccgaccagctggacattattattcgccgtattgccgacgtgctgaacaaggagcaaaccgcatgaccctgacgcccaatttctaccgcgaccgtgtctgcctgaacgtgctggcaggctcgaaagagaatgcccgtgaaatttacgacgccgccgaaggccatgtgctggtgggcgtgctgtcgaagaattatccggacgtggcgagcgccgtggcggacatgcgcgagtatgccgcgctgattaataacgcgctctccgtcggcctgggggcaggcgatcccaatcaatcggcgatggtcagcgccatttcccgcgaggtacagccgcagcacgtcaaccaggtctttaccggcgtgggcgcgagccgcgcgctgctcggccagtcggaaaccgtggttaacggtctggtttcccccaccggcacgccggggcaggtgaagatctccaccgggccgctgagttccggcgcaccggcgggcatcgtgccggtggagaccgccatcgcgctgttaaaagacatgggcggcagctcgatcaaatatttcccgatgggcgggctggactgccgtgatgagtatcagacggtggcggaagcctgcgcccgccatgacttctggctggagccgaccggcggtatcgatctggagaattacagtgagatcctgcgcatcgcgctggacgccggtgtaccgaaaatcattcctcatatttatagttccattattgataaagtaagcggtaatacccgcccggaagacgtgcgccagctgctggcgatgacccgggcgctactgccgtaaccagaggacaccgacgtgcgatttccgaaccaacgtttagcgcagctgttcgacatgctgcaaaacgagacgctgccgcaggacgagctggcgcagcggctgtcggtgtccacgcgtaccgtgcgggccgatatcaccgcgctgaatgcgctgctcgccagccacggcgcgcagtttatcctcagccgcggcaacggctatcagctgaaaatcgacgacgccacccgctttcactccctgcaaacggatcgcccgcgcgcgctgcgtattccgcgcagcgggcaggagcgggtgcactatctggtggtgcgttttttaacgtcggccttctccctcaagctggaagatttagctgatgaatggtttgtcagccgggcgacgctgcaaagcgatatggcggaggtgcgtgactggctacagcgctaccatctgacgctggaaacgcgcccgcgtcacggcatgaagctgttcggcagcgaaatggcgatccgcgcctgtctgacggatctgctgtgggagctggcgcagcaggacgcccacagcccgctgttaaccgaggaggcgctgaaccgcggcgtgccggaacagcttgagaggctgctgcatcagtgcttcacccgccatcatattcgcctgacggatgagggcgagctgtttatccgcctctactgcgcggtggcggtgcggcgcatcagcgaaggctatccgctgccggaattcacggcggacgatggcgatgaaaatgtccacctcgccgcgcgggagatcgccgccaccctgcaacagctggcgcagaaaccgctcgccccgtcggaagaagcgtggctgcgggtgcacatcgccgggcgacaggtgcaggagatcgcgccgagcgctatcaatgccgatgacgacgaagcgctggtcaactatatccttggctttatcaatacccactacaactacaatctgcaaaacgatgcccagctgcatgcggatctgctgacgcacattaagaccatgatcacccgcgtgcgctaccagatcatgatccccaatccgctgctggataacatcaaacagcactatccgatggcgtgggacatgaccctcgcggcggtgtcgggctggggcaaatacacgccctggacgatcagcgaaaatgaaatcggcttcctggtgctgcatatcggcgtcgggctggagcgccattacaatatcggctatcagcggcaaccgcgcgtgctgctggtgtgcgatgccggtaacgccatggcgcggatgatcgaagcggtgctgcaacgcaaatatccgcagatcgaggtcaccagcacggtgacgctacgggattacgaacagcgcgacagcatcagcgaggactttgttatcgccaccgcgcgcatcagcgaaaaagacaagccggtggtcaccatcgcgcctttccccacggattaccagttagagcagatcggcaaactggtgctggtggatcgcacgcgtccctggatgctggagaagtatttcgatgccagccatttccgcattatcgatcgctcggtcgatcagcagacgctgtttgcgatgctgtgcagccagctgcatgaggagggctttgtcgatggggagtttgttgattcggtggtggagcgtgaggccatcgtcagcaccatgctcggcgacggcatcgcgctgccccacgcgctgggactgctggcgaaaaaaaccgtggtctataccgtgctggcgccggaaggcatccagtggggggatgaagtcgcgcatattgttttcctgctggcgatcagcaaaagcgaatatgaagaagcgatggccatctacgatatttttgtcaccttcctgcgggaacgcgcgctgacccgcttatgcgcctgcaaagattttaccgaatttaaaaccgtcgccatggaatgtgtgagccggttttaattaaggtaaaatatttatattaatgcctgcgctagcgggtatttttatttttacaagtttccccgtgaggttatttatcttttcggtggaagatcctgcggcagtatttcctgcccggtaatggcatcgacgatttgctctgagccatcaggatatttggttacggataccagccggccgccgtacagcgggatgccggacatctccagcgtataatccgttttcttaatttcctgtttcttaagctcttgctgcttcttgatttcttccggcgtctgcgaagacagcgtaatcttcgtggcgctttcttcggcgtccagcggcgatttgtcagtattaacgtctgtggatttactgttattccagacagtcgggttattatcctgattagataaaagcgattcaccgtgcgtatttgtcgcggtgattttttcaataccgttcatcatcatctccgggtcgaaaatgcaatagggcgcaggacgcggtgcgctcttttcgggaagagtgcgcagcatctgcaagggataaaggtgacaaaaaggttatcggcggggcagcgaaataatttaatacaaaataatcaacgtgcggtcgttctgtttttttgaaggataaggacaaattgttctactttcatgattgcgccgtcaggcttactctgtaagaacagccgacagaatttgaagtgaaaaacattcaggagaacgtatgtcagacaactttatttcgctcgcgacgcaacgcagaaccatctatgcactgggcaaggacctgccggtatcagaagatgaagtgattgccaccattcaggaagccattcgtcaggcgccttcggcattcaactcgcagagttcccgcgcgctgatcctgctcggcaacgaacacaataaattctgggagattgtgcgtgaacagttaagaaaaattgttcctgcagagagcttccacgccacttccgacaagctggacggcttcgccgccgccgcgggttcggtactcttcttcgaagatcaggacgtggttacccgtctgcaggagcagtttgcagcttatgccgataacttcccgatctggtcagaacacagcaccggtattgctcagtacgcggtatggctggcgctggcagagaagggcattggcgcgaaccttcagcactataacccgctggttgacgcagatgtgcagcaggcctggaatatcccggccagctggaaactgcgtggacagatgaattttggcgccatcctcgcaccggcgggcgataaagcctttatggacgacgacaaacgttttgtggttgcccgttaattaagaatgccgccagcaggcggcattcttattattgtaggtcgggtaagcgcagcgccacccgacaaacaagcccaattaccgcaaataatgcaccacctggttgctactcccgcgccagatcagcgacggatctttcagatcctgcacaaacttcccgtccaccagcacgttaatcagctccaccaccgccatttgcgcggcagttaactcctcaagcttataacccgtccacacccagatatccttgccggggcattcggcacgaatgcgctgcaccagcgccaggatctccggcacgttttgcggatgcagcggatcgccgccggacagggagatcccctggcgtttgatccgcgtatcgttcaaatcactgataatttgatcggccatttcacgggtaaacggctgccccgaattgagccgccaggtgcttttgttatagcagccagggcactcatgcacgcatccggaaacaaacagcgtgcagcgcgttccggggccgttcacgatatcgacggggtaatattgatgaaaattcataatgcataaccttgccgggtggcgcttcgcttacccggcctacagtgacagccgggtggcgttgaaggacacagactcaaccgatctgcccgtttcctaaatgcttcacgcggcgcttcacttcttcctgcttaccggcgttaaacggacgcgcatccgggctgcccagataaccgcatacgcggcgggtcaccgacacccgcgcggcgtcgtggttgccgcatttcggacaggtgaagcctttgctggtgcattcgaactcgccggtaaagccgcactcgtagcactcatcaatcggcgtgttggtgccgtaatagggcacatgctgatagctgtaatcccatacgtcttccagcgctttcaggttgtgctgaatgttcgggtattcgccgtaacagatgaaaccgccatttgccagcggcggatagggggcttcgaaatcgattttgtcgtacgggttcaccttcttctccacgtcgaggtggaaactgttggtgtaataacctttgtcggtgacgcccggcaccacgccgaactcggcggtatccagacggcagaaacgatcgcacaggttttcgctcggcgtgctgtagaggctgaagccgtagccggtctcttctttccactgatccactgcctgacgcagacgttcgacaatggcaatgcctttcgcgcgcagcgtctcgctgtcgtacatgtgttcgccgcccgccagcgcattaatggtttcatggatgccgatatagcccagcgaaatggacgcgcgcccgtttttgaaaatttccgacacctcatcgtccgccttcagacgcacgccgcaggccccttccatatagagaatgggcgcgacgcgggctttcacgccctccagacgggcgatacgggtcatcagcgctttccgcgccagctgcaggcgggcgtccagcagtttccagaatgtggcttcgtcgcctttcgcttccagcgcgatgcgcggcaagttcaggctgatcacgccgaggttgttacgcccgtcgtggatctgctcgccgttttcatcttcccagacgccgaggaagctgcggcagcccatcggggttttgaacgagccggtgactttcaccacctgatcgtaattgagaatgtccgggtacatgcgcttgctcgcgcattccagcgccagctgtttgatatcgtagttggcatcgccaggcttgtggttcaggccgtcgcggatggcgaacaccagtttcgggaacacggcggttttacgatttttgcccagtcccgcgatgcggttacgcaggatcgactgctggatcagccgcgattcccagctggtgccgaggccaaagccaaaggtgacgaacggcgtctggccgttggcggtgtgcagcgtattcacttcgtattccagcgactggaaagcgtcgtagcactctttttcggtacgggaatgggcgtagccgtccgcatccgggatgtgccactcttccgccgttttgcggtgttttttgaagctggcggtgacaaaaggcgccagcacttcgtcgatgcggttaatggtggtgccgccgtaaatatggctggcgacctgggcgatgatctgcgcggtcaccgccgtggcggtggaaatagattttggcggttcaatctccgcgttgcccattttaaaaccgtgggtcagcatgcctttcagatcgatgagcatacagttgaacatcgggaagaagggcgagtagtcgagatcgtggtagtgaatatcgccacgctcgtgcgccagcaccacgtcacgcggcagcagatgctgacgggcgtagtgtttggcgacgatgcccgccagcaggtcgcgctgggtggggatcactttgctgtctttattggcgttttcgttaagcagcgcggagttggtttgctccaccagaccgcggatctcctgattgaggcggccacgtttttcacgctcaatatcccggtcatggcgatattcaatataggcgcgcgccagctgcttgtacgggccggacatcagctggttttctaccgcagtctgaatttcattgatatccacctgactgcggcccttcatctgctgtcccacgacctctgcgacggtggcgcaataatctgcgtcatcgactcccgctgctttagctgcacgcaaaattgcttcctgaatgcgctctgagttgaaaggcactttacagccatctcgtttcatcacatgcggtgtcatgatctctccatttagaaacaggttatccacaaaagcggaataatattcacagcgggcatacgtctgtgccagcaggtttttcctcgcgcacggtcttttttatccacaaatctgagggataaaccagcggtgtggttgttgcaatattagacaattaatacaacatattgggtcggggcgggattttaagtcctatatatagtgatttgcatcaaacaagtttgcgattttattgatgcaggacaaggtaaaaacatgaccgtacagatggcgggcgttgcggggaatgtaaattctgatggagcgtttcgtggtttattgcgctctttttcgctccgacgaacggctttggttccagtaagttccgacaaacataaagccactcagtcgtaacaaaccctcatcgtaattaacgcgaggggttgagtccccgctgaaaccggcgagccggaggccggatgacaagggctggccgccatggatggcggccagaggcgatatgaggcaggaggccgaatcgagccgaccgcaggcagacgggcgggaggtgagcgcagtgcgcagcaccggtttctttgcggggccgcagggattgctaagggggccgcggtggcccccttagcacgttcaccgtcagcggcgtcacgcctgacacggaacgcaaagtgaacggaacattccaccgcaccgaacatcccccaaaaccaaacggaacattccacctgccctcatctaaaactaagcctccccctgcctccaccacaccgcctcatacggccttaacaccgccttcgcaggggcctgcgccacctccgcataattactcatcaccacccgccagtcgcccgccatctcctccggctcccatgcctgattctccccgctcagattcgccaccaccagcagcgtctgcccctgccactggcggcgataacaccacacgaaaggatgcgcaggcagcagatcctcataatctccccaggtcagcaccggctcgcgtttgcgcagcgcaatcagcgcctgataggtataaaacaccgagtccgcatcgcgcagcgccgcctccacgttcacctgcggatagttctcgcacagggcgatccacggctcgccccgggtgaacccggcatggggagaggcatcccactgcatcggcgtgcggctgttatcgcgggatttggaggcgaggatcgccagcagctgatcggcgtcctgaccggcggcgcggcgttcggcaaacatattgtggctttccacgtcgcggtaatcggtaatacgcgtaaagtgcgggttggtcatgccgatctcttcgccctgatagatatagggcgtgccctgcataccgtgcagcaccatggcgagcattttcgccgaggtgacgcggtattccccttcatccccgaagcgcgacacgatgcgcggctgatcgtggttacaccagaacagcgcgttccatgccacctgatgcatcccctgctgccagtagcggaacagcgtcttcagcgccacgaaatccggggccgccagcgtccatttctcgccgccggggtagtccactttcagatgatggaagttaaaggtcatcgacagctcgcggccatcctgggcggcatactgccgacagtgatcgagggtggtggaggacatttcgcccaccgtcatcagtccgcgcgggcggaaaacgtcgcggctcatctcctgcaaatattcatgggcgcgcggcccgtcggtgtaaaaacgacgcccgtcccccagctcatccggcggaaaatcctgatctttggaaatcagattcaccacatcaagacgcagcccgtcgacgccgcgatcggcccagaattcacacacctttttcagctcggcgcgcacctgcggactttcccagttcagatccgcctgctccggagcgaagaggtgcagatagtactgcccgctctccgcatgccagcgccaggcgctgccgccgaatttcgagcgccagttgtttggcggcgtcaggggcgagccgtcgcgccagatataaaattcgcggtacggactggcgggatcctgcgcatggcgaaaccaggcgtgctgcgtggaggtatggtttaacaccatatccagtacgatgcggatgccgcgcgcatgggcctgggtcaccatctcgtcaaaatcgtccagcgtgccgtatcccggatcgatggcggtatagttcgccacgtcgtagccgttatccacctgcggcgagatataaaacggcgtcagccagatggcgtcgacgccgaggattttcagatagtcgaggcggtgtgttacgccgcgtaagtcgccgcgtccgctgccggtggtgtcctggaagcttttggggtaaatctggtagatagcgccggtctgccaccagtggggaagtgtattcatcgtgtcgtcccgatcgtaaaaaggggcgccgtcgcgcccccgaagcatcaaacaatctgtagcgatccctggcgggctttgcgctggtacataaaggtcgtgagcactaatggcacgacaatggcgataaccatggcgatgccgtagacctgccagtaaccggtctggatagaaagaatacccggcagaccgccgacgccgatgccgttcgccatcacgccgtataatccgcacagcagcgcggcgaggcaggagccaatcatcgcgcacagcatcgggaagcggtatttcaggttgataccgtacattgccggttcggtcacgccgaggaaagcggagatagcggcaggcaccgaaatctcacgttcattctctttgcggctgacgatgatgatccccaccacggcggacgcctgagcgatgttcgacagggcaatcagcggccacattggtgtgccgcccatgctctggatcatctgcatatcaatagcgagcgtggtctggtgcaccccggtgatcaccagcggcgcatagaggaagccaaacagcgccgcgcctatcggggcgaagctgccggtcatcagatggcgcatggcaaaggccacgccgtcgccgatcagacgaccaaaggggccgataaaggcatgggcaaggaacactgcgaggagcagcgagcagaccggcaccaccaccagatagaggtaggcggggacgatacgcttcagctgcaattcaatatagccaagcgccagacccgccagcagcgccgggatgacctgcgcctggtaacctactttatcaatgctgaacaggccaaagttccaggcttccggcacctgctggcccagtaagtaagcgttcattaactgcggcgaaaccagcgtaatgccgagcacgataccgaggatcggcgtgccgcccattttcttcaccgccgaccagcagatccccaccggcaggtagaagaagatcgcctcgccaatcagccacaagaagtcataaatggttttcagcgccggggacatttgcgccagcgtctgtccgttgctcatcggcagatcgccgataacgttacggaagcccagaatcaaaccgccgctgatcagcgctggcagcagcgggaagaagatctccgcaaagtgcgagatcagctgctcgtaccatttcatattctggcgcgccacccgtttggcgtgctctttatccgcatgagcctgaccggtagtggcgagcaggactttgtagtagtcgccgacatcggggccgatcaccacctggaactgtccggcgttggtaaagcagcccttcaccattttcagtttttcaatggctttcggatcggctttcgccgggttatcaagcacaaagcgcaggcgggtaatacagtggctgacggtggcgatgttatcccgtccgccaaccagctcgattaatttatcgatgtcagcttgatctacttttttgctcatcgtgaagcctcacagaggttttggaattatgcgtagggaacagctgaaagagtatctgcggatcggcaaaagcgaaaagggaacgttcccgaaatcggttaaggatcacactaaatcatacaagcatagattaaccgaggcgggcggggacgataatggtgcgcggttcggcgcggccggtgatctgatcgatcagctgggtggcggccatacggcccgcttcagcgtagccgggatcgacggtgacgatttccggatgcaggaatttcatcagcggcgtattgccgacgctggccagttgcagggcggtgatgcgctgctcctgtaagtacttactcgcgccgagcgccagagtatcagtggcgcagaccagcgcagtagtgtccggcgttaagacgcgggcgacgtgctcataaccctgtttcatcgccaggcccggcagcacggcgacgggctgcatctgatgctgtgcgcagaaatgcagataggcgtcgtggcggcgctggccggtggtggtgtcgctggcaggcacgccgagatagctgatatgccggtgcccctgggcgtagagcttttccagcagcatctggatcgcccgttcatcgtcataacagacggaggcgaagccgctggcgtcccgcgccatcagcaccagcgaagactgccagggcgcaagcagggtttccgtgaggccagtaaagccgaacagcaccacgccgtcgatattgcggcgacgtaacatgccaagatgctcttccaccagcgccggagagaactgactttccatcatgatcggatcgtaaccctgggcgtaaaacgctggcagcatggtctgtaccgcaaggttttccgacagcgaatccaggcgcgtgacgatgatcgccacgatgttatcgctctggccgcgcattgcccgcgccgagcgggacggggagaagccatgctgttgcatgacggcttccacgcgctcacgggtctggacgctgacgccgctctcattattgagcacgcgcgaaacggtggatttacccacgccgcttaagcgggcgatgtctttgattgtcagtcggttttgcatgcgtcctttcctttgaggtcggtatcagcctaatgattctgcgacaaaatacaatgcacaacgtctggtttacgtccggtttagttgccgggcgttattatgcgccgcaacttcaccttatcacttttaccggaggcaacatggatcctgatcccacccctctccccgacgggagttttcccgcgttccggtaagcctgttttcgctgccttgccggacgcgtagggcagcgacgttttacgtccctgcaaaataacatttgcgcctgcgggcgcagagggactttttatgctgaaaaattttatccggcagcgcttctttgcgctcagccgccatttaccacgccgtctggttgaccgcagcccgctgccggatgccactaccgcaggcgtaaccccgatcccggcttcgctcagcgctcactgcctcaacgtggcggcgatggacgaatctcaactgtggcgcagcttcggcagccatcctgaagggcttaacccgcaggaagtcacggccagccgcgacaagcacggcgaaaaccgcattccggcgcaggcgccatcgccctggtgggtgcacctgtggctgtgctatcgcaacccgttcaatttattgctgacgctgctcggcgtgatctcttacgccaccgaagatatgtttgccgcgggggtgatcggcctgatggtggcgatcgccacgctgctcaattttatccaggaagcgcgatccacccgcgccgccgacgcgctgaaagcgatggtcagcaacactgccaccgtgctgcgggtgatcaacgacaaaggcgaaagcgcctggtgcgaactgccgctggaagaactggtgccgggggatattgtccggctggcggcgggggatatgatccctgccgatttgcgcgtgatacaggcccgggatctgttcgtggcgcaggcctcgctgaccggcgaatcgctgccggtggagaaactcgccgtcacacgtaatgccgcgcaaaccaatgcgctggagtgcgacaccctgtgctttatgggcactaacgtggtgagcggcacggcgcaggcgatggtcatcgccaccggcggcaacacctggtttggtcagctggccgggcgcgtcagcgaacagcccaccgagccgaatgcgttccagaaaggcatcagccgcgtcagtatgctgctgatccgttttatgctcgtcatggcgccgctggtgctgttgattaacggctacaccaaaggcgactggtgggaagcggcgctgtttgcgctgtcggtggcggtgggcttaaccccggaaatgctgccgatgatcgtcacctcgacgctggcacgcggcgcggtgaaactgtctaaacagaaagtgatcgtgaaacatctggacgccatccagaacttcggcgcgatggacatcctgtgcaccgataaaaccggcaccctgacccaggacaaaatcgtgctggagaaccacacggacatcgccggaaaagttagtaagcacgtacttcacaccgcgtggctgaacagccattaccagaccggtctgaaaaacttgctggacgtggcggtgctggaaggggtggacgaagacagtgcgcgggagctttccacgcgctggcaaaaaatcgacgagatcccttttgattttgagcgccgccgcatgtcggtggtggtggcggaaacgccggatgcgccgctactgatttgcaaaggggcgttgcaggagatgctcagcgtctgtagccatgtgcggcataacggcgaggtgacagcgctggatcaggctatgctgcgccgcatcgagcgcgttacccagacgctcaaccgtcaggggctgcgtgtggtggcagtggcgagtaaatacctcgcggcgcggcagggggattatcagcgtgccgatgagtcagacctgatcctcgaaggctatatcgcgtttctcgatccgccgaaagagagcaccgcaccggcgctgaaagcgctacacgccagcggcatcacggtgaaaatccttaccggcgacagcgagctggtggcggcgaaagtgtgccacgacgtcgggctgaacgcgggcgaggtggtcaccggcagcgatatcgaagggttaagcgatgacgagctggcggcgctggcgcagcgcaccacgctgttcgcccgtctgacgccgatgcacaaagagcgcatcgtcacgctgctaaaacgtgaagggcatgtggtgggctttatgggcgacggcatcaacgatgccccggcgctgcgggcagcggacattggcatttccgtggacggtgcggtggatatcgcccgcgaagccgccgacatcattctgctggaaaagagcctgatggtgctggaagctggcgtgatcgaggggcgtcgtacttttgccaatatgctcaagtacatcaaaatgaccgccagttctaacttcggcaacgtgttcagcgtgctggtggcgagcgcgtttctgccgtttttacccatgctgccgctgcacttactgatccagaacctgctgtacgatgtgtcacaggtggcgatcccctttgataacgttgacgatgagcagatccagaagccacagcggtggaaccccgccgatctggggcgctttatgctgttctttgggccgatcagttcgatcttcgacattctgacgttctgtgtgatgtggtgggtgttccacgccaacgtgccggaagcgcagacgctgttccagtccggctggtttgtggtggggctgctgtcccagacgctgattgtgcatatgatccgcacccgccgcgtgcccttcttccagagtcgcgccgcctggccgctgctgatgatgacggcggtagtgatggtattgggcatcgggctgccgttctcgccgctggcaagctatctgcaactccaggcgctgccgctggcgtacttcccgtggctggcggggattttgctggggtatatggcgttgacgcagctggtgaaaggattttacagccgccggtacgggtggcagtgaggggggagttgtgctttaacctgtttgccgggtggcgctacgcttacccggcctacaggttagacgtaggcccggcaagcgcagcgtcgccgggcaacgatgctttaacggcgtaccgcaatcgcttcgatttcaatcttcacatctttcggcagacgcgccacttccacgcaggagcgtgccgggaaggtggcgttatgctcggtgaaaaatgcttcataggtggcgttaacggtggcgaaatcgttcagatctttcacaaacaccgtcgttttcacgatgtcgcccactttcaggcccgctgcttcaacgatagctttcacgttttccagcgactgacgcgcctgagcggaaacgtcgtccggcacggtgccggttttcggatccaccgggatctgcccggaagtgatgatcatactgcccagatcaacaccctgaacataaggaccaatggctgctggtgcattttccgtcgcgatggttttagtcatgatttctcctgaataacagcgaaaataaggggttccgcgccattataggcagcgcagaacccattaccaacctcaattagctggccagcaccacataatgggaaaactctttttcacagtatttgcatttgagcgcgatgtcgctggcgcgttttttcactgcaaaactggagaaaaccggttcggcatggctgatgcagttactattcgggcacaccagcacggcgtcgatgcgctccggcagtttcgggcgcgattttcccaccacttcatactcatcaatgcggtttaccgtcgcgtccggcgcatataaagagagctgatccacctgctcatcggtaagaaaagtgttctcgattttgatcagatctttgcgccccatttcgcctgacggcaaattcaggccgatggtgatgcgctgatcggtttcggtcagcttgaacagcgtcagcagcttaaagcccacctgcgccgggatatggtcaatcacggtgccgcgtttgatggcttcgacctggagtttattatcgtgtgtcatctcagtgctccttacagaaccaaatcgcgattaagaaccagcgccagcagcgcctggcgggcaaagatgccgttaccggcctgctggaagtaccaggcgtgcggggttttatcgacatcggtgtggatctcatccacgcgcggcagcgggtgcagcactttcatattggcgcgcgcatgcgttaagtcgctggcgcgcagtacaaactgcgccttcacgttggcgtattccgacggatccaggcgctctttctgcacgcgggtcatatagagaatgtccacttccggcatcacctcgtcgatgctgtcatgcacgctccacgcaatgcccttttcgtcgagcatatccagaatgtactgcggcatcgcaagtgctgcaggcgcgataaacaggaagcggttgccgctgaatttcgccagcgcctgcgccagcgagtgcacggtgcggccatatttcagatcgccgaccatcgcgatattcagattttccaggcggccctgggtttcctgaatggtaaacaagtcgagcagggtctgggtcggatgctggttcgagccatccccggcattcagtaccggaatgccgccggaaaactccgtcgccagccgcgccgcgccctcctgcgggtgacgcatgacaatcgcatcgacataggtgctgatcaccgaaatggtgtctgccagcgtttcgccttttttacccagcgaggtgttgctgctatcggagaagccgaccacgctggcccctaagcggtgcatggaggtttcaaaagagaggcgggtgcgcgtggaggcctcaaaaaagcagctggcgatcactttgtgcttaagcagctccggttgcggcgtggccttcagtctggcggcggttgccagcaccagttccagttcttcgcgactgagatcatttatggaaatgatatgtttttgatagagcggattagccatcgttctctcctgacgcctgcgcaaaaaaaagcccctcaataagaggggctgtgaatatcgtgagcaacgggaagaaaaacggcaggcctgcgtctgttttcagacgcggtaagacgcgatgtcgtacgcagttgaccatgctttcctcccggcaaattgcccggcattatactcagctgcttttgtggatcaagtgattcaatgcacgatttgtataaggcaaacggttattttgcatatcaatgcattcttaacagataattaacgcgtttatgcaccagtgcggtacgcgagacatcccgtggcgcgacccagacaatgttgctgctcgccaccacgccgagaatgtccgggatcgcatgataatccagtatcctggcgacggcgcgcccgtatccggcggcggtatggataaggataaactcactattgtgctcaacgctgaccaccatttccgacacggatcgcgcggcatcgggtgccgggcgtaactgtggattcacggaataaatcttttgtcctttcgcgttgcgtatttttatcacgcccagcagctttaacagccgcgaaacggtggactgactgatgctgtcaaaaccatgcagctgtaaatcgcggcggatcgcctcctgcgataaatagcttttctccacaataagacgctggcagacagcgagctgaagttgctctctggcggtgcattctgcgtattccttcatcgttttattccagttagttgccaaaatgcccggtggcgcgcgccatccggcgaaaactagagcagggcgccaagacttaacacaacggtgatcaccaccgtcaggatcaacagcaagggcgcaacccacttcaggtaacgcacataaggtacgcgcgcaatggccaggccgcccatcacaacggcagaggtgggtgtgatcagattcacaatgccggaggcggactggtaggccgtgaccaccagatcgcgattgacgttagcgaaatccgccagcggcgccatgatcggcatggtcagcaccgccagacccgaggacgacggcaccaggaaagagagcaccacttccagccagtacatgacattgataaaggcgacggtggacagcccgctcaccatcccttcggcgctgtgcagaatggtatgggtgatcatgcctttatccatgatcaccacgatgccgcgcgcgatgccgatgatcaacgccacgccgagcagatcccgcgcgccgttgataaaggtggaggtcagctcctcttcgctcatgcgggcaatcagcccgacgataatcgccgccgccagaaacaccgccgagatctccgccatccaccagccgagcaccgccacgccgtagatcattaccgcgaaggcgagggcgaagatcacgaggataagtttgcgcaccggggtgaattccagcatctcctgcggcttatcgccaagaaaatgcgcgcggttttcgtcaagcttatccgccacgatggagctggccggatcctggcgcactttacgggcataacgcatcacccaggccacgcagatcagccagcctaccgccagcaacagcacgcgcagtaagatgccgttggtaaaggggatcccggcggcgttggcggcgatcaccgtggcaaagggattgatggtggatccgagcgtgccgatccccgcgccaagcagaatggttgaagcagccaccaccggatcaaaacgcgccgccagcatcaccggcaccagcagggtgtaaaacggcagcgactcttccgccatgccgtagatggtgccgcccgcagcgaacaggcccatcaggatcgggatcatccactcttcgtggccgtgcagtttcagggtgacgcgggcgatcccggcatcgatcgccccggttttggtgacgatccccagaaagccgccgatgatcagaataaagagcgccacgtctatcgcgcccgcctggccggtgacgggatcgtacagcccgccgatgggggccatcagcacggcaaccagcccctgcggatgggcggcgacctgcgcgtaggtgccggccaccggcacttctttgccgagggtctcgttcatcatcatctgatactgcccggcggggacgatccagctcagggcggcgaccagcgcgatgaggataaataaaatggtgtaagcggaaggaaatttgaacttgcccatggggtgatctccctgtgcgggcgcgccagctcaccggcgcgcccggataattactcgccgagtgtcgccaccatgaccgctttaatggtgtgcattctgttttctgcttcgtcgaaaacgatggagttcgccgactcaaacacctcttcggtgacttccagccccttcagcccgtaggcgatttcgatttcccggcccatggtggtgtgctcgttatggaacgcgggcaggcagtgcataaatttgacgttcgggttaccggtggctttcacgacggcgctgttgacctggtaaggtttcatcaggctgacgcgctcggcccaggcttctttcggttcgcccatcgacacccagacgtcggtgtagagaaaatcaacgccgttgacgccttcttcgacgtcctccgtcagcatgatgcgcgcgccggtttcgcgggcgatagcgcggcactgcgccaccagcgcctcttccggccagaaggcgcggggcgcgaccagacggatgtccatgcccattttcgctgcgcccaccatcaggtcattgcccatgttgttacgtgcatcacccagataggcgaagcgcagttccggcagggtcttgcccggcgcatgttccagcatggtcatcaggtcggcgaggatctgcgtggggtgaaattcgttggtcaggccgttccataccggcacgcccgcgaattcgcccagttcttcgacaatggcctggccgtagccgcggtattcaatgccgtcatacatgcgtcccagcacgcgggcggtgtctttcatcgactctttgtggccgatctgcgaaccggacgggccgatataggtgacctgcgcgccctgatcgaaggccgccacttcaaaggcgcagcgggtgcgggtggaggttttttcaaaaatcagcgcaatgtttttcccggtcagggttggctgttcacgtccggcttttttggcggctttcagttcgatggccagatcgatcagcgactggatctccgccggggtgtaatccagcagcttgaggaaattgcggtttttcagggagtgggacataagtatttccttattcagtttttaacgcctgatggcggctgcgccttatccggcctacaggccgtaggccggataaggcgcagccgccatccggcaaaagggtatgaaggcttaatgccggatcaacgtacctttctcaccggcgaggatcgccgggccgtccgtcagcgcgcctatcccggcgatgccgtggcactcgtcgacaaaacggcaacaggcggcgactttcggccccatggatccggcatcaaaggtcattccgttaagctgttctggcgtgacctgggtgagcgggcgctgggctggcgtgccccagccgacatagaccgcatcggcatcggtgaggatcagcagcgcatcggcttcgatctgccgcgccagcagagccgcggagagatctttgtcgatcaccgcctcgatgccgtggtagccgtcggctttctccaccaccggcacgccgccgccgccgttgcagatcaccagatggtcacggccgatcagcgcgttaatggcatcgcgctcgacgatgcgccggggctgcggcgagggcaccacgcggcggaaataattcccgtcggctttgaaggtccagtctttttccgctttcagtgcggcggcctgggcttcgtcatacaccgggccgatgtatttggtcggctggcggaaggccggatcggcggcgtccacttccacctgcgtgagcagcacgctgatctcccgctgcggcagcaggtttttcagcgcctgttgcagcatgtagccaatcattccctggctttccgcgcccagcacatccagcgggtagggcgtgaccttgtcataggcgctgttttgcagcgccagcaggcccacctgcggcccgttgccgtgcaccagcaccacgcgccagtcgtgagtcagccgggcgatggtctgcgccgcgagcagaatatttttgcgctgaatatcggcttccagcggctcgccgcgttttaacagcgcattgccgccgagggcgacgacgagagtgggtttcagttgcatgggcgtctccttaaatgccgtcgcgttcaagcgggcagctcatgcaacgcgcgccgccgcgaccgcggcccagttcgtcgccggggattggcagcacggtgatgcctgccttatcgtatttttcgttggtccagatgttgcgctcatagcccaccaccacgccggggcgcagggttaacacattgttggcgtcgttccactgttcgcgttccgcttcaaaggcgtcgccgccggtggtgatcaggcggatctgcgtcacgcccagggctttttccagtgcaggcaacaggccaggctcctgtaaacggctgatgccgccgcgtccgtccggggtcagcgtccagcactgggcgtctttgcgcaccacttccgggtagacggagaaggtatcgacgtctatatgggtcatcacggtatcgaggtgcatacaggagcggtgcttcggcagttccacggcgatcacccgctcggcctggcgatgtttaaacagggcgctggcgaggaattccaccccctgcggcgtggtgcgttccgacataccgattaataccgcgccgcggccaatgactaatacgtcaccgccttcgatggtggcatggtcataattaatattttcatcgccgaagtatttaataaaatcgccgtcggcaaactgtggatgccagcgataaatggcgcgcagattattggtttcccgctgacgcgccggtttcgccatcgggttaatagacacgccgttatagatccagcaggaggtatcgcgggtaaataaatggttaggcagcggcttcataataaagtcattcgctgaatgggtatccaccaccatatttttaataaaggccggtatttcgccgtaggtcaggccgccgcttaaacgccgcgccagttcgcgatgcggcatatccgccagccagccgcgcacgtcggcggcaaaggcaggcccgaggcggtaatccgacacctgggtttgcaacagccagcctttggcgtccgggacgtccagcgtctgggtgagcagatcggtgagcagtaacacttccacgccctgatcgcgcagcgtagtggcaaaaatatcgtgctcctcgcctgcacgctcaaccgataacacgtcatcaaataacaactcctggcaattcgatggcgtcagtcttttcaggctaagattggggcgatgcaacatcacgctacgcaattggccaatttcagaaccgacataatgcttttccatatttattccttgcacttttttagaaataaaggggccagcgttatgaaaagactattttcataacccttcgtattcaggtgaattcggcggtaatactaatggctgtcgctattaataatgtgatattgctcacgtgaaaccggcactgttgaggtttatttcttattgcatgacgggcatcagagaatactcaaatggctattttaaagcggtgcattgctacgcattaattgctgtcattatttttagttgttaatgttttgtacattgactcattaattatattttatctatcatgctgaaatttatggataaaataaagatgttcgcatgaatatgcaaaatggctaataaattattgcggcattaagtcgaattaaaaaataaatatgaaatggtgtgcctgaatatgccgtacggcaaaatgtgagcagtaagtggtttttttgataattacattattttcagcaggttgcagagcaaggtgcaaagccggcgcaaaaagttatgcagtattactgcatacgcccggacgcatcgttaacagtctggtaacaggcttgcagataaacatgcgttatcgcaaatcttttccatttagaggtggtgcagcaaaaggatttttcgtataacacataaaaatgaaacagtgttttatatgaggggttcatcatgatcgttggcaacatccataatcttcagtcctggctgccgcaggaactggcacaggctatcgactacgttaagcagcacgttacggacgcaaccccgaccgggaagcatgatattgatggctcgcgcctgttttatctggtgtctgacgatatgacgcagccgttcgccgagcgccgcgccgagtatcacgcgcgctatctggatattcagatcgtgctgaaggggcaggaaggaatgaccttcagcaccctgccgaacggtacgccggataccgactggctggcggataaggacatcgcgtttttaccggcaggcgagcaggaaaaaacggtggtgctgagcgaaggggattttgtggtgttctatccgggggaagtgcataaaccgctgtgcgccgtaggcgaggccgcgccggtgcgtaaagtggtggtgaaactgctggtggcgtaatggtattgccgggtggcggctgcgcctgacccggcctacaacatcttcaacatcgatgttaaccgtaggcccggcaagcttgcgccgccgggcgatacatcactccgccagggtcgccaccatcaccgctttaatggtgtgcatacggttttccgcctgatcaaacaccacgctgtttgccgattcaaacacctcgtcggtgacttccatgccgccacgaaggccataggtctccgccatctgcttgccgagcgtggtctgatcgtcatgaaacgcgggcaggcagtgcaggaatttcacctgcgaattgccggtcagcgtcagcatctggcggttcacctggtagccgcgcagtagtgcaatgcgctccgcccacttctctttggcttcgcccatcgatacccagacgtcggtatagataaagtcagcgcctttcacgcccgcggcgacatcttccgtcagcgtgatattgccgccgtttttcaccgccagcgccgtgcactcggccaccaggctcgcgtccggccagcaggctttgggtgcgaccagacgcagatccagcccgaccagcgcggcggcttccagcatcgagttgcccatgttgttacgcgcatcaccggcatataccagcgtcatctcattaaaggctttgcccggcagatgctcctgcatggtgagcagatccgccagcaattgcgtcgggtggaattcgttggtcaggccgttccataccggcacgccagcatattctgccagcgtttcaacaacttcctgcccgaaaccccggtactgaatgccgtcgtacatgcgtcccagcacgcgggcggtatccttaattgattctttatgcccaatttgactaccggcagggccgagataggtgacgcgtgctccctggtcaaatgcggcaacttcgaaagagcatcgggtgcgggttgagtctttttcgaagatgagcgcgatgtttttaccagtaagctgctgtacttctttaccttttttcttatcggctttcagttgcgcggcgagcgccagcagggtgtggatttcagcgggtgtaaaatcgagcagtttaagaaagtgcttccggaataatgcagacatatttccctcacatggcttaggccacttattgaattaaaattcactttatatgtgtaaatattcatttgcaaccctgtttaacaaatcttttcggtcaggagtggaggcattgtcagcggtgtgtgaaaataagagtatctgccgcacattatgaggaacgatccatggcaaacccggagcaactggaagagcaacgcgaagaaacgcgtttgattattgaagaactgctggaagacggcagcgatcctgacgcgctgtacaccatcgagcaccacctttccgctgacgatttcgaaacgctggagaaagtggcggtcgaggcgttcaaactgggttatgaagtcaccgagccggaagagctggaagtggaagaaggcgaagtggtgatctgctgtgacatcctcagcgaatccgcactcaaggcagagctgattgatgcgcaggttgagcaactgatgacgctggcagaaaaattcgacgttgaatacgacggctggggcacctactacgaggatcctaacggcgaagaaggcgacgacgatgaagatctgctggacgaagacgacgacggcgttcgccactaagtaaaagtgcggcagcgcctgctgccgtaccacctttcccgcaggcattcccaccaaaacgccctcaaatgcaccaatttctggcaggtgcgaccgaatccgatgttgcgtaacatacctctcctttttttcactataactttttaacaacctatacagagagtcaggatgaaactgtcacggatcgtcatatcccttatcgtcgtacttgttgtcgccactgccgtcggtttttttatcggttcccgtccctcgcaatccggactcaccgaggagcagaagtttgacgccgcgatggcgcaatttccctcctttacagtgctaaaagagcaggagccggagtactggtcgaagctgcgtggccgcgcgctggctatgcagaaagagggcaaaacggagcaacaaatcatcgacgtcatccagccggaaattttgcagatccagatctcgcgtctgcaatcggcgccggacgatcaggtggtgcgctatatgaaagtgaatatggagcagacggcggcgatccagaaggtgagtgacgatgactgctaccgcttcctgttcccgaacgtgaaaggcggtatcaatccgatgcgtgtactgtccaaagagatgctgacctaccgcgccaccgtggacgccgatatgatgcgttcggcatacggcgcgggcaaacacactgcgacgccgcaggagcgtgaacgcgcccagcaggatcttcaggccgttgccgccacgctggtgaaaaaatatggcgatgatgtggccatcttgtctgagccgcagaagggcgtgggcaaagagaagctgacctgcgatatggtggaagagatgtggagcaatgtgctggcgctaccggctgataaagccgcgggtattgtgcgttttatgatggcgcaataacgcctctctggtggccctcccgaaaagggagggcctgttaacgagtattacaacgctttcagcatgcggacttcgcagtccacgtgcccggtgcagcccagcggcgcgtcgatatgcgcaaagcccaggcgctcatagagcgcaatggcgtctttaaggaaggccgtggtttcgaggtagcagcgggtaaaaccctgctcacgggcgaaatccagggcagaaagggcgagctggcgcgccaggcctttaccgcgaatgcccggcaggaaatacattttttgcagttcgcaaatgtccggatcgctacaggtcagcggcgcgataccaccgccgcccattacctggccgtcctgctccaccacccagtaagcatggcgtggctggctgtagagctggaacaacgcgtccagattcggatcggccacggtgtagcctttatccgccgtgagtccgaattcagccgaaacctcgcggatcacgcgggcaatggccggattatcattttcctggagagggcgaagccgtaattcgcctgtcatactgagtgcattattctgcatgggataacctggaaacgtgggacagtaaaagtctttggacaagcccccactataaaacagacctcgcgggatgaaaaataaaagcctgcattaacacttttccattttattgccggtatacggcaatgaagttcagcgcagtacattgtgctgcgtgacgttaattcccccttgtaataagggttttaatcattcatttcaggacgaaaaagtatggattccttaactaaaacacagcgtcatcaaatcaagtttcacggggatggcggtaactattttacaatatggctggtgaatatcttcttgtctgttattacccttggcatatattccgcctgggcgaaagtcagaacctaccgttatttttatggcaataccgagctggcgggcgatcgctttgattatcatgcccgtccgatgcaaattctggtcggtcgtatcatcgcctttgttggcatcgttattttctacctttgtttcatggcaagtgaagtgctgggaatggtgatcatgctggcgtttattgcgttactgccgtggattattatccgcagctggcgcttcaatgccattatgtccagctaccgcggcgtgcgttttaactacctctgccgcgttggtcgcgcctactgggtattcctcggcttcccgctgctggctttcgcggcgctgattgttatcgtgtcgctggtgaattttttcaccaacccgatgctgggtattctgctgatggtggtgatttttgtgccgggcgcgatcctcattcaggggattaattccgcgctgacttacgacctctacgtgaacaaccttttctttggcgatgccgcgttcaaaggcgacatgaataaagacgcctttgtcaaaatggcctttaaagccgcgctctttgtggtgccggtgctgattattcttgggctgatcttcgccaaaatgttttactccattatgcaggcgagcgtctacggtggttctgaagatgcgatcgccatgatggtgctcagcaatataggcctgattattctggcttatgtggtggcgctggcgggtggcatgatggcggcggcctggctgattgtggcgcaccgtaattacgtggcaaatcagaccacgctgaacggcggcgcgctgcgtctgcactccagcatgaaattcacctcctacctcggcctgctgttcaccaatgcgctgatcgttatcttctctttaggcattgcctcgccgtttgctcatgtgcgtcatgcgcgttacctgctgcaaacgctggaggtggaaggggatctggatctgctgaccgtacgcgcccacggtgaacaggctcccgctgccgtgacggaagagctggtgcaggcgctggatatcaatgtcgggctgtgatctcagcggcttttatcagtatcccggtcgggctgcccgtgaggcggcccgtctgacgttgcatgacggggcggtgacgctgcaccgggatagcggcgacgagacgtacccgctggcggcgctgaccgtgtcagaggcgctgggagatattccgttgtcgctcacctttgccgacggcggccgttttgcgccgggtgacgataaggcgtttcgccagtggtatttccgccaccggcgtccggggctggtccaccgcttagagcagcacaaacgcggcgtggtggcgatgctgctcgccaccgtgctggtgggggtattttacgtctgggtgctgctgccgtggctgagcggcgttatcgcccatcaattaccggtgagcattgagcagcagcttggccgctacagcgccgcttatctggaagagcaggggctgacggagagcaaactgagtactgcgcgccagcagcagttgcagacgctgttccggacggtgatcccgcaggatatgcgcgatcagacgggcctgcgcctgcgcatcatgcatttcccgctcggggcgaatgcgttaatgctgccggatggcaccatgatgctcagcgaccagctggtgcggctggcgaaaagcgacgatgcgctggccgccgtgatgctgcatgagatcggccattaccgttaccggcactccatgcagatggtggtgcgctcgtcgctgatctccatcaccctgatgtgggtgatgggcgacgtcagcggcatcggcgataccctgttgcagtcagcggtgctggtgaacgagatgcgcttctcacgcagtatggagagcgaagcggatcgctttgcgctggcggaaatgcagcgccagggacgaccgttaagcgcgatgctgcaaattttcaccgcgctgggcgagcagggcaaggatgacgacaagtgggcgatcccggactggctcagcacgcatccggcgatgcaggagcggctggaaagcatccgcaacgccacgcaataaaaggcataaaaaaaccgggcgcagcggcccggttttttattcacgatgaaccgcttacagcgcggcgatcacgccctgctgctcaatcagcttcgctttggcctgggcgaatccgtccagacgctcgcgctctttggcaaccacggcttccggcgcgcgcgccacaaaaccttcgttacccagtttgctttcgattttcgcgatttcctgctcgatcttcgccacttctttcgccagacgctccagctcagcggctttgtccaccagaccggccattgggatcagcagctcagcgccgtcaacgattttggtgaccgataccggccctttgtcgtcggcaggcagcacggtaatgctctccagacgcgccagggtttgcaggaagctgcggttttccgtcacgcgacggataacctcatcgctgcaaccgcgcagcagcagcgccagcggtttggcaggggagaggttcatctcagcgcgaatattacgcaccgcgacgatcgcctgtttcagccactcggtatccgccagcgccgcgtcgtctgccagcgccgcgtcaaactgcgggaagggttgcagcatgatggtgtcggcggtaatgcctttcagcactttcacgcgctgccagatggtttcggtgatgaacggaataatcgggtgcgccagacgcagcagaccttccagcaccgtcaccagcgtattacgcgtgccgcgcagttccgcttcggaaccgccgttcattaccggcttggtcagctccagataccagtcgcagaactggttccaggtgaactcgtacagaatgcccgcggcaatatcaaagcggtagctgtccagcgcttcacggtaggctttcaccgtacggttgaactcggcgaggatccagcgatccgccagcgacagcgtcagttcgccgccattgaagccacaatcctgatcttcggtgttcatcagcacaaagcggctggcgttccacagtttgttacagaagttacggtaaccttccaggcgcttcatgtcccagttgatgtcgcggccggtcgaggccagcgccgccagggtgaaacgcagggcgtcggtaccgtgcggctcgatgccgtccgggaactgtttctcggtacgcttggcgattttttccgccagctgcggctgcatcatgttgccggtgcgtttttccagcagatccggcagggagatgccgtccaccatatccagcgggtcaatgacgttacccttggatttggacatcttctggccttcgtcatcgcggataagaccggtcatgtagacggttttaaacggtacctgcggcttgccgttttcatctttgatgaagtgcatggtcatcatgatcatgcgcgcgatccagaagaagataatgtcgaagccggacaccatcaccgaggtcgggtggaactggcgcagcgcgtcagtgttttccggccagccgagggtggagaaggtccagagcgcggaggagaaccaggtgtccagcacgtcttcgtcctggcgcagggcaacgttcgcagagaggttgttttcgctgcgcacttcttcttcgctgcggccaacgtagacgttgccgtcgttgtcgtaccatgccggaatacggtgaccccaccacagctggcgggagatacaccagtcctgaatgtcgcgcatccaggagaagtacatgttttcgtactgcttcggcacaaactggatatcgccgttttctactgcttccaccgccggtttcgccagcacgtccgcacggacataccactggtcggtcagcatcggctcgatcaccacgccgccacggtcgccgtaaggcacggtcaggtcgtgcggtttgatctcttccagcaggccgagggcgtcaaccgccgccactaccgctttacgggcagcaaaacgttccagcttctggaactgcgccgggatcgcgcctgagtaaacgtcggattcgttgcctttggtgtcatacacttcggccacgtcacggatgtcgccgtcaaaggtcagaatgttgatcatcggcagctggtgacgacgacccacttcgtagtcgttaaaatcgtgcgccggggtgatcttcacgcagccggtgcctttggtcatgtccgcgtgctcatcgccgacgatcgggatgcgacgatccaccagcggcagcatgacgaatttgccgatcagatctttataacgcggatcctccgggttaaccgccacgccggtatcgcccagcagggtttccggacgggtagtggcgaccaccaggtaatctttgccgtcggcggttttcgcgccgtcagccagcggatagcggatgtgccacatggagcctttcgactcgcggttttccacttccagatcggaaatcgcggtgcgcagtttcggatcccagttcaccaggcgcttaccgcggtaaatcagatcttctttatacaggcgcacgaagacttcttttacggcgttggacaggccttcgtccatggtgaagcgctcgcgctcccagtccacggagttaccgaggcggcgcatctgacgggtaatggtgccgccggattccgctttccactgccagattttgtcgataaaggcgtcgcggccgtaatcgtggcgggttttaccttcttcggcggcaattttgcgctcaaccaccatctgcgtggcgataccggcgtggtcggtacccacctgccacagggtatttttgccctgcatacgctggtagcggatcagggtatccatgatggtttgctggaaggcgtgacccatatgcaaactgccggtgacgttcggcggcgggatcatgatgcagaagctttcctggctttcatcgccattcggtttgaaatagccctgctgctcccagtgctcgtaaagcggctgttcgatatcttgtgggttatatgtcttttccattatttccaggttgccgtattcaggttaaaaccagccaggcgataggctttatagcgctcgcgagccagttgtttcaaagtttcttcgtaggggacgaagtctaccacttctgtgaaagcggtggcaaaatctgcaaagttaacgcgtaaagcgattaacagatcgcgcgggctgctgttgcgtttttgcggccaggcgatctccaccggcgcgccgccccgtggtccttcacccgccagattatgcggcacaaaactctccgccggacgcgcccacagggcctcgtcaagacggatcgcctgttgctcatcctcgcaggcgatcagcacgcgcttgccgttgcgccaacgttccgcggcaatttcacacaccagttgttcaacggcgctgaggccatctgtggtgtcgtcattgtccagaaggtagaacgtcgcgtttttcatgatatggggcttctttgatggatttaaatgtgaagccgggtggcgcacgcttacccggcctacggttgagtggcgtgtaggccgggtaaggcgaagccgccacccggcactttacatcactcgtcgccgttaaaacccgcgcgattgagcaggaactgcgacagcagcgccaccggacgaccggtcgcgcctttagctttgccggagcgccatgcggtgccggcgatatccaggtgcgcccagttatatttacgggtgaagcgcgccaggaagcagcccgcggtgatagcgccgccaggacggccgccaatattcgccatatcggcaaaattagattccagctgttcctggaactcatcggccatcggcagacgccacgcgcggtcgcccgcctgttcggaggcgctgatcagttcgtgcgccagcggattgtggttcgataacagaccggtgatgtgatgacccagcgcgatgacacaggcgccggtgagggtcgccacgtcgatcaccgcttccggatcaaaacgttcaacgtaggtcagcacgtcgcacagcaccagacggccttcggcgtcggtattcaggacttccaccgtctgaccggacatggtggtcagtacatcacccggacgataagcgcgcccgccaggcatgttttcacagcccgccagcacgcccacgacgttaatcggcagctggagttccgccaccatccgcatgacgccgtacaccgccgccgcgccgcacatgtcgtacttcatctcgtccatgccttcggcaggtttgatggagataccgccggagtcaaaggtcaggcctttacccaccagcacaatcggacgcgcgtcttcgtcgctgctgcctttgtattcgataacggacatcagggattcattctgcgaaccctgaccgaccgccaaataggagtgcatacccagctcgcgcatctgctgctcgccgatcacgcgggtgacgacgttctggctgaaggagtccgccagctggcgcgcctgggaagccagataaccggcattacagatgtttggcggcatattgccgagatctttcgccgctttaataccggcggcaatcgccagaccgtgctgaatagcgcgttcgccgctggtcagttcacggcgggtcggcacgttgaacaccattttacgcagtggacggcgcggctcgctttttgtggttttcagctgatcgaagctgtacagcgtctcttttgccgtctccaccgcctggcgtactttccagtacgtattgcggcctttaacgtgcagttcggtcaggaagcagaccgcttccatggagccggtatcattcagggtatttatcgttttctgaataacctgcttatactgacgctcatccagctcacgctctttgccacagccgatgagcagaatacgttcggaaagcacattaggaacgtggtgaagcaataacgtttgtcccggtttgccttccagttcgccgcgacgcagcagcgcgctgatatagccatcgcttattttatcgagttgttcggcgatgggagaaagtcggcgtggttcaaatacgccaacaacgatgcaggcactccgctgtttctccgggctaccgctttttacactgaactccatgcactacgctcctgaatcttaaagacaacagccatggctacggatagaattgcaagctttcgtaactcatgtccgctgttgcggtgacttcgtgttaatcttaacgttattacggttcaacacgtcagaacttattctaaaccgcgaatccgctgagttttgttatcttagcgatgatttcaacgactcaagagaataaatgacgtttaagccatgaaacaagcgattttcctgcaaaaaacgggtttttacgggcgtatttaaagtgataatcataagatatttggtgcgggagacgctcaaaagccagttggcgatcctattcatcctgcttctgattttcttctgtcagaagctggtcaggatcctcggcgcggcggtggacggtgagatcccgacaaacctggtgctctctttactgggcttaggcgtgcctgaaatggcgcagctgatcctgccgctcagcctgttcctcgggctgttaatgacgttgggtaaactctacaccgacagcgaaattacggtgatgcatgcctgcggcctgggcaaggccgtgctggtgaaagccgcgatgatcctcgcgctgctgaccggtatcgtggcggcggttaacgtcatgtgggccgggccgtggtcggcgcgtcatcaggatgaggtgctggcggaagccaaagccaaccctggcatggcggcgctggcgcagggccagttccagcaagccaccgacggcaactccgtactctttattgaaagcgtggacggcagccgctttaacgacgtcttccttgcgcagatccgcccgaaaggcaatgcccgcccgtcagtggtggtggcggattccggcgagctgtcgcagaaaaaagatggctcgcaggtagtgacgcttaataagggcacgcgctttgaaggcacggcgatgctgcgcgacttccgtatcaccgacttccaggactatcaggcgattatcggccatcaggccgtggcgctggatccggacgataccgagcagatggacatgcgtacgctgctcaacaccgataacaaacgtgccaacgccgagctgcactggcgcttaacgctgatcttcaccgtctttatgatggcgctgatggtggtgccgctgtcagtggttaacccgcgtcagggccgcgtgttgtcgatgctgcccgccatgctgctctatctggtgttcttcctgctgcaaacctcgctgaagtcgaacgcggcgaaagggcgaatcgatccgctgatctggatgtgggccgtcaacctgctgtatctggcgctggcgattggtctgaacctttgggacacggtgccgatgcgccgtctgcgcgcccgtttcacgcgtaaaggagcggtataatgcaggcatttcgcgtactcgaccgctatatcggtaaaaccattttcaccaccatcatgatgacactgttcatgctggtgtcgctttccgccattatcaaatttgtcgaccagctcaagcgcgccgggcagggcagctatgacgcgctgggcgcgggcatgtataccgtgctcagtatcccgaaagatattcagatcttcttcccgatggcggcgttgttaggcgcgctgctggggctggggatgctggcgcagcgcagcgagctggtggtgatgcaggcctctggcttcacccgcatgcaggtggcgctgtcagtgatgaaaaccgctatcccgctggtgctgctgaccatggccatcggcgaatgggtcgccccgcagggcgagcagatggcgcgtaactaccgcgcgcagcagctttacggcggctcgctgctttccacccagcagggcttatgggcgaaagacggcaacaactttgtttatattgagcgcgtcaccggcgatgcctcccttggcggcgtcagcatctatggctttaacgatcagcgtcgtttgcagtcggtgcgttacgcggcttccgccactttcgatcccaatgccaaagtgtggcgtttatcgcaggtggatgaatctaatctgagcgatccgaaacaggttaccggctcgcagacggtgagcggcacctggaaaactaacctgacgccggacaagctgggcgtggtggcgttggatccggatgcgctgtcgatcaccggcctgcgggattatgtgaaatacctcaagtccagcggccaggattccgggcgctatgaactgaacatgtggagcaagatcttccagccgctgtcggtggcggtgatgatgctgatggcgctgtcgtttatctttggcccgctgcgcagcgtgccgatgggcgtgcgtgtggtgaccggtatcagcttcggcttcgtgttctatgtactggatcagatcttcggcccgctgaccctggtgtacggcatcccgccgattatcggcgcgctgctgcccagcgcctcattctttgccatcagtctgtggctgatgctgcggcgttcctgataagtcatcccctctccaccctggagaggggacatttcccccccgataattctgtactttgcgacgttctctgctacgcagactatgctatgcatacggttaactaaattatcaggtagttatgtccagatttttctttaatgaccgcaagcagctggtcaacgacgccattgaaggccttgtcatctccgcccctcacgccaaccttgtccgccttgatattgatcctgccatccgtgtggtcgcccgcagcgactggagtaaaagccgtgtggcggtgatctccggcgggggctccggccacgaaccggcccatgcgggctttgtcggcaaagggatgctcaccgccgccgtttgcggcgatgtctttgcctcgccaagcgtggatgcggtactgaacgccattgtcgcagtcaccggcgatcgcggctgtctgcttattgtcaaaaactacaccggcgaccgcctgaacttcggcctcgcggcggaaaaagccaagcgctacggcctgaaagtggaaatggtgatcgtcgccgatgacatcgcgctgccggacaacaaacagccgcgcggcatcgccggtacggcgctggtacataaagtggcgggtttcgccgctgaacagggcaaatccctcagcgaagtgcgcgacctggcgcagcaggcctgtgacaacgtctggagcctcggactggcgatggaaacctgcaacctgccgggcagcgatggcgaagaagagaaccgcattcagcgcggtcaggtggagctgggtctcggcattcatggcgaacccggtgccaccacggtggactcgcacaacagcaaaaaacttattgataccctggttggcccgttaaaagagaaggcgggcaatgaccgcgtggcggtgctgatcaacaacctcggcggcgtctccgcgctggaaatggcgctgctcaccaaagagctggcgcactcggcattaaaagatcaaatcgcctatctggtcggccccgcgccgctggtcagctcgctggatatgaaagggttctcgctgtcgctgctgcgtctgaatgacacctttgaacaggcgctgtgcgctgatgtcgagaccgtcggctggcagaaaccggtggccttcgcgccgatgcgcaccgtcagccacaacgccattcacgacagcctggaaattcagccctctgataacccgcaggtgaaggcgctggtgaaaaccgccaccgacacgctgattaaccttgagaaccgcctgaacgcactggacgccaaagtgggcgacggcgataccggctcgacctttgccgaaggggcgcgggatgtggcgcaactgctggcggacggcaagctgccgcttaacaacaccgcgcagctgctgcaactggtgggcgaacgcctggcgacggtgatgggcggctccagcggcgtgctgatgtcgatctttttcaccgccgccggacaggcgatccacgacgggcaaccgctgccggaagcactgttaaaagggctgaagcagatgaagcattatggtggtgccgatctgggcgaccgcacgctgattgacgcgctgcaaccggcgctggaagcgctgcgcgatcacgatctgatggcagccattagtgcggcgaaaaagggcgcagaagctaccgcatcgatgcaaaaagcgggggcgggacgctcgtcttacgtcaaccgcgaaaacctggaaggggtgaccgatccgggcgcggtcgcagtggctgaagtctttgctgctctgaagaaggtctgaatacgcaggcccggcaagctacgcgccgccgggcgttttaccctttaaaaatccgcttttaacaccacgcgataacgggctttgccgtcacgcacatgttgcagcgcttcattaatttttgacatcgggaacagctcggtggtcggtgccacctgcgcacgaccggcaaatttcatcagcttacgcagttcgtacggcgtacctgtggcagagccggagatgctgcggtcgccgccaatcagcgtaaacgccggcaccggcagcggtttcagcaccgcgccaacggtgtggaagttgccgccataggccagggcttcaaagtacggctgccattccagatcgacgttaacggtattgatgatcagatcaaactgaccggccagcgctttcagggcttccggatcgcggctgttcaccactttatctgcgccaaagccgcgcacttctgcttctttcgccgggttggagctgaacgccgtcacttcgcagcccatggcgcgcagcagtttaatggcgatatggcccagaccgccgataccgatcacgccgacgcggctggtagcggtgacatggtgcatcagcagcggtttgaataccgtgataccgccgcacagcagcgggcctgcggtttcaatatcaatgctgtccggcagcgggatcacccattgccagtcggcgcgaattttatcggcaaaaccgccacggtttaaaatggtcggcaccgcgccttccagacagttgatctggttgccgctgatacaggcatcgcagtgcccgcagctgcgcgccgtccagccaatacccacgcgctggcccactttcagacccttgtcctgcgcatcgcggccaagggccaccacgcggccaatcacttcatgaccggcaaccagcgggtactgcgacatgccccactcgttatcgatcatggataaatcagagtggcagataccgcagtaatcaacctgaacttcaacgtcagccggcagcagttcacccgcatcaaattcatgtagttccagatcggcaccggcctcaggggcggcgtaactttttatgatgctcatcacaatttccttcggttggcattgattagaaagaagtgtagagcattccgtaaggggcgacttagcggaagagggcattcagctaagtcgtcttatacttcatgctgatgaacagtgaccggagaacctaatgaccttacgcgcggcgatagtgttgctgacgggcgggctgccttttttcgcctcagcccataactttgtggaaggggaacgtgtgccgccggtgggggtggcagatcgcggcgagttgcagcttcagcaggaggcgatccgctatcaggtgtggaacagcgcgcgcctcggtggaaaagtgggcgtggtgctgcatatggcagggcgactctccgccaaagatcagaacgccgcgctgatcgacgctatcggcaaagccgggctgcccgccagccggtttgcggtcaccaccatcgtcaataccgatgacgccattcccggcagcgcgctgttcgtgcggcgcagtctggaggagagcaaacgggaaaccccggcggcgcagtttgtggtggacgatcgcggctcggtactccgcgcctggcaactgcaaccgggcggttccgccgtggtggtactggataagagcggacgggtgcgcttcgccaaagacggcgcgctgtccgctgcggaggtggatcaggtgatggcgctgctgcgggaactgctggcgtagtcgctcattgttaaagcaaggtaaatagttgtgatgaaggcgttgcgtaaaagcaaatatctgtagagtgcgctacgcttttcagacaaagcaggatgcaaataaacaggcaagcggctgttcaggctgcaaaagttcctggtcagattatgacggctcgatggcagccgtcacatgcgccattcgcatcataccgccacgacgaggaaccatgaccgtaacgatgaaggttaacgccgataactgcctgaaccatgaagatgagttacaggcgctgcgcgaggcgctgcaaatccgcctcgatcagctgttgcctgcgggccagcagcaggatctggtctatacggcgatgcgcgaaggcacgctggtggcgggcaaacgggtacgcccgttgctgctggtgctggcagcgcgcgacctcggctgtcatgccgatcagccaggcctgctcgatctcgcctgcgcggtggagatggtgcacgccgcgtcgctgatgctcgacgatatcccctgtatggacaatgcgctgctgcgtcgcggccgcccgacgatccaccgccagtatggcgaaaacgtcgctatcctcgccgccgtggcgctgctcagccgcgcctttggcgtggtggcggaagcccagtcgctgtcgcctgcctgcaaaaccctggcggtggcggaactctccaccgccgtcgggttacagggactggtacaggggcagtatctcgatctgcacgagggtgccgggacgcgcagcgccgaagcgatcctgctcgccaatgaactgaaaaccagccgtctgttcgacgccacgctgcaaatggcggcgatcgtcgccgatgccccgccgcaggcgcgtcagcggttgcgctgctttgcgcaggatctggggcaggcgttccagttgctggacgatctggccgacggcctgaacggcaccggcaaagatgtgaataaagatcacggcaaatcgacgctggtggcgatgctcggcgcggaagcggtgcatcagcggctgcgcgatcatctgcgcagcgcggatgaacatctcaccagcgcctgtcagcgcggtgtctccacgcggcgctttatgcacgcctggttcgacaaacagatggcgctgttcggctaacacgttttatctcaggacgccacatcgactggagcggcaatgaaggacagggaactgactcaacgcaaaaacgatcatctggatatcgtgctggatccggcgcgggcgctgaaaaagcgcggcaccggttttgccgactggcgttttgaacactgtgcgatgccggagctggatctggacgccatcgatttaagcaccacgctgttcggcagaacgctgcgtgcgccgctgctgataagctcgatgaccggcggcgccagccgcgccagggaaattaaccgccatctggcggaagcggcgcaggcgctcgggctggcgatgggcgtcggctcccagcgtgtggcgctggaaagcgaagataactgggggctgacgcgcgaactgcgccgtgccgcgccggatattccgctgctggcgaacctgggcgcggcgcagattgccgcccaccatggcatcgattacgcccgccgcgcggtggatatgatcgaggcggacgcgctgattattcatctcaaccccttacaggaagccttgcagggcggcggcgaccgcgactggcgcggcgtgctggcggcgatcgcccgcacggtgaaagcgctgccggtgccggtggtggtgaaagaggtcggcgcagggatttccgtgccggtggcccgccagctggctgatgcgggggtggcgatgctggacgtcgccggttccggcggcaccagctgggcagcggtggagggcgaacgcgccgcgacgccgcatgaccgcgccgtggcgatggcctttgccgactggggcatccccaccgctcgcgcattgcgcgatctgcatcaggcgctgccgcagatgccgcttatcgcctccggcggcgtcagcgacggcatcgacgttgcgcgcgccatcgcgctgggcgcgaccctcgcaggccaggccgcaggggtgctcggctgcgccactgcctccggcgacgcggtgatcgcccattttcagatcatcatcgatcagctgcgggtcgcctgtttctgtaccggcagcgccagcctgagcgcgctgcggcaggccagactggtgcgcgtcggggatgaggaatgagccattacgcggttatcgcgccaccgctctacagtcacgtgcgcgcgctggaagcgctggcgcaggcgttaatcgcccgcggccatcgcgtcacctttatgcagcaggcggaagcgcgcacgctgcttgacgacgcgcgcatcggtttttatccccttggcgaacgcagccatccccccggcagcctggcgcgcaccctggcgttaacggcgcacccgtcaggaccgggtatttttcggctgattgaagacatggcgaaaaccagcgacatgctctgccgtgagctgcccgccgcgctgcaacaggcgggtatcgacgggctgatcgtcgatcagatggaggcggcgggcgggctggtcgccgaagctctgggcctgccgttcgtctcggtcgcctgcgccttgccggtaaaccgtgagccgcatctgccgctgccggtgatgccctttaactacgccaccggtccacgcagccagaaactttatgccaccagcgagcgcatctatgactggctgatgcgccgccacagcgaggtgatcgcacgccatgcgcgcgcctttggccttggcgagcggcgatcgctgcacgactgtctgtcgccgctggcgcagatcagccagacgctgcctgcttttgattttccccgtcgccagctgcccgcgcactttcacgccgtcgggccgctgcgccacagccacgccgcgccggaggaggtacagacttccgcgcagccgctgatattcgcctcgctgggcacccttcaggggcaccgctacaggctgttccgcaccatcgcccgcgcctgccgccagctgaacgtccggctgcttatcgcccactgcggcggcctgaatgaggcgcaggaagcgcgactgcggcgctacggcgcggaggtgactgattttgccgatcagcctgccgtgctgcgccaggcgcaggcggtgatcacccacggcggactcaatacggtgatggacgcgatagagagcgccacgccgatcctaactatcccgctggcgttcgaccagccgggcgttgccgcgcgcgtggtttacagcggcattggccgccgcgcttcacgctttaccaccgcaggcgcgctggcgaaaaacctgaacgcgctgctcaacgacgcccgctaccgtcagcagctacgcctgatgcagacgcagcttgccggtgctggcggcgcgaccagcgcggcggaaatagtggaacaggcgctcaacagccgccacccgatcctggcggcctgcgcatgacgcagtacgatctgatcctcgtcggcggcgggctggccaacgggctgatcgcctggcggctgcgccagcgtcagccgcagctcaaagtgctgctgctggaggccggtgcagagccgggcggcaatcatacctggtcatttcatcacgaggatctcaccccgacgcagcacgcctggatagcaccgctggtggcgcaccgctggcccggctatgacgtgcgctttccggcgctgacccgccggttcgacggcggctatctgagcatcacctctgagcgcttcgcacttgagatggcgcaggcgctgggggatagcctgcgaaggcagacgccggtcagcgcgctgacgccccggacggtgacgctggcggacagcacggagcttcacgccggtgcggtgatcgacgggcgcggctatcagccgggcgaacatctgactattggcgcacaggcgtttctcgggcaggagtggcggctcagccagccgcacgggctgacgcgcccgctgctgatggacgccaccgtggatcaatcggcgggctatcgctttgtctatacgctgccgctctccgccgacagcctgctgattgaagatacccattacatcgatcgcgccacgcttggcgacgatcaggcgcgccagcatatcgtcgattacgcggcggcgcagggctgggcgctggagacgctggagcgggaagagcagggcaacctgccgatcaccctggcgggagactgtcgcgcgttctggcggcagaaggcgggccagccctgtagcggcctgcgcgccgggctgttccactccaccaccggctactccctgccgcaggcggcggcgctggcggatctgatcgctgcccagcgcgacctgtcgtccggcgcgctcttcgccctgacgcgggactacgcgcagcagcagtggcgtcgccagcgtttcttccgcgtgctcaatcgtatgctgtttcttgccggacgacctgaccgacgctggcaggtgatgcagcgtttttaccgacttaacccagggcttatcgcccgcttttacgccggtcagcttaccctggccgacaaagcgcggatcctgacgggcaaaccaccggtaccggtgggcgaagccctgcaggccgtactcaaacacactccccggctgcgagcgttcagtgatgaataaaacagtagtaataggcgctggtttcggcggcctggccttagcgatccgcctgcaggcggcaggcattcccacgcagctgctggagcagcgcgacaagcccggcggccgcgcctatgtttatcaggatcagggttttacttttgacgcaggtccgacggtgatcaccgatcccaccgccattgaagagctgttcacgctggcgggcaagcgcatggccgactatgtcgatctgctgccggtgacgcccttttaccgcctctgctgggagacgggccaggtctttgactatgacaacgatcaggcgcggctggaagagcagatccgccgctttaacccccgcgacgttgaaggctatcgccgctttctggcgtactcgcaggcggtatttaaagagggctatctgaagctcggcactgtgccttttctgtcgttccgcgatatggtgcgcgccggtccgcagctggcgcgtttgcaggcgtggcgcagcgtttacggcatggtgtcatcgtttatcgaagatgagcggctgcgcgaggcgttctccttccactccctgctggtgggcggcaaccccttcgccacctcatccatctacacgctgatccatgcgctggagcgcgaatggggcgtgtggttcgcccgcggcggcaccggcgcgctggtgcagggactggtgcggctgtttgaggatctcggcggcacgctggagctgaacgccgaagtcacccggctggaagcccgcggcaacgagatcggcgcggtgcagctggcagacgggcggcgcattgaggtggcggcagtcgcctccaacgccgatgtggtgcacacctacgaaaaactgctcggccatcatccggtgggtgcgtcccgcgccgcgtcgctgaagcgcaagcgcatgagcaactcgctgttcgtgctctattttggtcttaaccatcaccacagccagctggcgcaccacaccgtctgcttcgggccacgctataaggcgctgattgacgatatttttaaccgcgacgccctgtcggaagatttctcgctctacctgcatgccccctgcgtcaccgatccttctctggcgccgcccggctgcggcagctattacgtgctggcgccggtgccgcacctcggcactgccgatctcgactggaatgtggaagggccgcgcctgcgcgaccgcatcttcgcctatctggagcagcactacatgcccggcctgcgcgaccagctggtgacgcagcgcatgttcacgccctttgatttccgcgaccagcttggcgcgcatcatggctcggccttctccgtcgaacccatcctgcgccagagcgcctggttccgcccgcacaaccgcgacagccgcattcccaacctctaccttgtgggcgcgggcactcatccgggcgcgggcattcccggcgtgattggctcggcgaaagccaccgcagggctgatgctggaggcgctggcaccatgaacagcacgctgatggaacacgctaccgataccatggcggccggatcgaaaagcttcaataccgccgcaaagctgtttgacgcgccgacccgccgcagcgccctgatgctctacgcctggtgccgctactgcgacgatgtgatcgacggccaggtactgggctttcgggatgcctctgccgttaccggcagcggcacgcagcggctggcgatgctgagaaccgagacggagcgggcgtacgcgggcgcaccgatgcaggagcctgctttcgccgcctttcaggaagtggcgacacgccacgctattccgccacagctggcgttcgatcatctggaaggcttcgccatggacgtgcgcgacacccactatgagacgttcggggatacgctacgctactgctatcacgtggcgggcgtggtggggctgatgatggcgcgggtgatgggcgtgcgcaacgaggcggtgctggatcgcgcctgcgatctggggctggcctttcagctgaccaacatcgcgcgggatattgtggaggatgctgaagccgggcgctgttacttaccggcgcagtggctggcggaggagggcatcgaacgcgaacagctcgccgatcccgcgaaccgtgagaagctggcgcggctggcggcgcggctggtggacgccgccgaaccttactacgcctcggcacgcgcgggcctcgccggtttgccgctgcgttccgcctgggcgatcgcctcggcccatggggtgtaccgggagattggcgtaaaggtgaaagctgccggcccccgcgcctgggatcggcggcagggcaccagcaagggggagaaaatcgcgctgctgctcaagggcgcagcgcaggcggtcagctctcgcgccgcgtcgacgtcgccgcgttcttctgcgctgtggcagcgtccgcggcatgacgatcgcgcggtatagccttctcgccctgcggcggtctgccgttacggctgcgcaggatcgcctggagctttgagaccggcggcgcatagagaaagccgaaggagacgcagtcctctttgccacgcaccgcatgatgcaggcgatgcgccatatagagacgtttcaggtagccgcggcgaggaatatagcgaaacggccagcgctgatgcaccagcccgtcatgcaccataaaataaatggcgccgtagagcgtcatgcctgcgccgatccactggagcggccagacgccggacgtgccgacagcgatcagcgctatcgccagcacggcgaacaccacggcatagagatcgttgacttcaaaccagccggtgcgcggttcatggtgtgaaagatgccagccccatccccatccatgcatgatgtatttatgcgccagcgtcgccacgatctccattgcggcgacggtcgtcagcacaatcagggtgttccacagcacgagcatcgtgactccttgttttgagatgatgcagagtatagcaagggagtcaccatgctgccgggcggatgggagacgggcagggctaaggcgaaattttcggcacttagcgcacgctacggacaattgaggttgcgaaggtggccggtaagggtataatcctcaacgttttccgcatacctttccgtgccggagtggcgaaatcggtagacgcagttgattcaaaatcaaccgtagaaatacgtgccggttcgagtccggccttcggcaccatcggaatgctaattaagtcgcctaagggcggctttttttgtgcaaaattccagcagttatcacttttttatcatctctcccacccatatttgatgggctatgaattgtacaattcatctaattttgggcacatcagtatttagagctgaacttcaatgtgtgtgcagttaagtcaaaatatagcattcatatcttcatcattttcgggttatgagacgccaaatacattcagaacttagaaaggtagtagagatagcgtactcatttatataaaatggttattatttttcctcagagaccatgcggttatgagcgcaatcacattacgtaaagcgttgggtgtactggcgaagtcttcttcgttttcagtgactacggtgactcaacgagaaagagatgagtatgatcagttaaaagaccaactgtttgtaaagcaagaaattgaatctgaattgcaacgtcatctggatgttgcgaaacctggcgaaatcatttttttatgcggcagtagcggggatggcaagtcagaaattttaactcggtgtaaggctgatccacgctatcagcgcaaatttagatttcatcttgatgccacacatagcttttctccccgacaatcggctatcgaagcattgaatgagctttttagcgagcacgatcaacaatcactgccgttactaattggtatcaatactggcatgcttgctaattttgcccgagaaggcgatgagaagcacacagcacttaggtcagcgattgatttatttttatcagttcaacagcacgcaagcagaccttaccgtaacggtaattgttctttttttgactttgaacattatccaaaattccagtttgatgaaagcggaaattattcaccatttatcaaaagtttgataaacaatcttacttgtgatgatgatggcaatttatttcaatttattttaagccgtgatgagcaaactaatcccgatctgaaagaggtggcaaattttaggctacttagcatgccaggtgttcaggatgtattaataacacagctgtttaaagcccggttaattaaggatcagtttgtcacgacaagaacattgctggactttttgcatcatttacttacggggactggttatttgtttgataacctcttcactggtgaagaaaatgatcttattagaaaggtttctgattttgatcctgcgcgcttgcatacatatgaacttgatcagttcattttacgctatgagcttagactagttgatgccgacttagatgaatttttgtccgcacttgagagtttacatattaaattcgatcgccattatgccaagcctggagatgctgcttccttgattcggcttttttggttacttcagcatgagtcattaggaaataattatcataagagattctcaagattctttaacgaaaccctctttgaacgctattcagagatatggcatcagcataaaaattacacggcaaatccagaacagaaaaagacacttaatcgtttttacgcttttgaacttattgctggtattcaacgatatgctaatcgtaaagctccagaattaaatatgcagaaagaggagttctttctgggagagtttggtggagttaaaataaccgcgccggtagaagtaaaaccagattgggacgctctacgtaataaacatacggcacattcaactggctttgatgtttatctcaaagtaggtgaaacctcgctgccgcctgttcatattggactcaatctttttgagttattgcataaattgaacaatggctatcggccgaataaatatgataaaaatgcgatagtattgcttgatgagcttgttgaacttattacagatcaggctaaatctagccgcgaaattaaattttacgctagccgatcgcgagttttccgcgctaaagccgatgacgacatgatcaccattagcggtatggagggatagtatggtgtaccctatcgcatcaactttaaaagttggtaataatcaggtagatagctacttgcctgttcgcaacaagaacaatgaaatcaattggcaatttgttactgggttagtgcttagctatgcgctaaaacgtaaaatagaagcctacgatccagatcaatttcgtgatgattgtaaaagtcacttacaaacactgcttgatgagccagaattttggtcggtgcttgagcggatgtacttttccagccaggatatcttccgtgtttcgccgctatttttattgtttcacgctcaattttctggtgaaaaactgatcgcaggttcaacggctgataaacgccttggaacattgttctctaatttaatgggcaatttcagtcttacttacccgattgaggacaaactaaatttcattgagcaacaaatcttgaataaactcaatgaaaaaataaaactgctcgggaaaggtccatttgccgaagagcaaccttatctcccttatatggcattatgctttcaggctgacctggagtttctggcggagcacccgcagtatctcttacaagaattaactaatacactgcgtttgtacgcttttagctggtgtgctcaattagcacttaatttggacagttggcaagatggcgagccacagagcaagtctttatttttcattctggacagtgaaaaagccagctctgaacgagaaaaagttaaacgatatggatataagttatttgctagccagagtgaaaagctttttccagtactttctgcactagaaattttgcagtggggaaaaggggagaaaaaacgtcctctttggcaaatttatcaagatagtctgaataattcagagtcttcttcacaagtattacatcatctaaataactatttacatgattttatcgaggatcgcggtcttgagcttcgtgaacctgctaccagtctggagcatgctttcaagcaactaattactgtcgccattgagcaatttcagggtaaaaagtctgatcgtgcaacagtaaaccgaaaatacgttaatgaattagaaaatgaaatatgcattgacttcattcaggtaagaggtcgagcaggtaaagtgttagttttaaatcaggaccgtttattattactgactaaccttacggttggtaaaaatgacaaactccgcctacatgaactgttgcgcggttttgaacagcgcggtttttatctggataaccagtcggcgcaaacgctggtggcgttttatgaacgcatgggaaatgtagagcgaatgagtgatagtggagatgccgtatatgtccgtaaaacagtatgaaacttatctggcggaaacctttattgaatgggttggcggcattatccaggcaggtgaacgttaccagttcaaatgtcccgatcctggtaatgctttaaaactttggcaagcttttatcgatcttgcaggcgaaaatcaacttgagtctgagccgggacaacacctggcatatgtctcttgcgatagtgtgatgctgattcctgtcttgcatggcgctgacgctcctgcattcacggaaaattatatttcccatctgcgagatgtggttgcaggccgcagtggagctttttcccaaacagcactgttgatcatacataacagtatgctcgatacattgattaatagtacgaaagatgtggctgctccagatgcaatctggtacccgcaaacctttagccatcagcttgaaaaactcattacatctgataataagcgtgctgaattgacccgctgtttgctggaggatcaactggcgacggtactggatgaaggcgcgaccgtatttggtttctcgtcgctgtatcgcttgctggatgatggtaatctggatttctccgagcttcatctttttaaagatgatgaacttctgaactatagccagaagcagctacgcactcgactgaatgaaaaccggaaattatatcgccagattgaagacagtgttgaacgctacggtgggcagctggagaatgtgctgcctgagtttagtacaaaattcattcaggagcatttttacgacaaagatgactggcgtgagctcgatttctccgattataggaaagagaaagaacagaataatgaacaaaaactggtgctggagaacgtttccgtcgaaaacggcgagatttggcaacgggcgaaaagcgccagtaaagcaggaaaacgtgacatcagcctgctggtgcaggtacagccaggacaatcaaaggctgagctggagttcagttttcagggtaatgatcttcaggataaccagataaagattgcccataatcgccagttaaagaatgcacctttctggcgcaccagtcgggcaggcggcaagacttcccgcattatggcgtcggtgccttttgacgggcatccctgcttttttagtctcgaattgaccaaccgtaataattcagccgaagagtataaatttcgcctgttgttggtcgagcaggggcaattctggctaaacgatattcagcactgctaccgcgttgagccaggtaaagaccaaataaccctgcaactagaagataacacgctgcgtattgccgagtctggcaacctaacctgtatgttggatgacgagagcgaagacatcgactgccagcattatgctcaggtggattttgagacgctggcaaatcaaagtgacctagttcagtttgcgatcgtttccggtgattcccgtctgtcgtttaacatcgaggggccgggagcagaagaagggctaacgctgccgctgctttttgaccaaagtcgtttcaataagttgttcaaagaagagggcaatgcaacctggaaccgactaaaagggcgcatcattcttgataatactgaacacaaggtcgtcggtgtacgccagcagctgttgatactggaagcctcattaattgagcaacgtctgctgggtacgggaagtgacaatagcgagtttgcgctggatgaacttcttgccagttaccccgatctccataacgcctatgagcagttatttgcctactatcaacgtcatagcaccctggcgagtttggtgtcgtggtcaacggagtaccgcacgctggttagtaacattgttagtacgtttgaacaggcactacagcaaatcggtctgagcagagcgctgatagcacaggagaaacgtcttctgcatctgggggtctgccgcaatgatagccatgagcgcctctctccgctacatccactagtactggcctaccatttacaattggcagaaactatcgttgcggagacggaacagcacgattcggcttcatttgccacactaccggcgattactcttgatcgcctgatggtgtctggcttaatgccgtttgtttaccacagtgagcatgaatatgcgcaactacagccagtagaggaaaaccgcttctggattgatgtcgtcccccagcgccaggttagtcatgactacgttaagcgtctggtaaaagacaaactcaatgaattcactgacgcctacgctcgattgttccagaacgccggaaacgatgctttagttatcaatgccattaatcagggaaatgctaaagagctatttttagggttagtggaatattttaaacaggaaaaagagcacgctatttcggtgcatgtgaactgttacgacgaacgcttgctacccaatatgttcgatcactttgccgaaagtagcagctatgaacagcttaaaaacgatcttgatctaaacagcggcgcatggcgggcggaagctgatatgctgattgacttgctgcgcagccgattaacgtttagcaagtttgtcctgccatcagaaagtgagaaattggcctatgcgcacctggcttttttcaccaacacggcaccggtcgattgccgccaaatccgcattgaagatgcgtccagtggggtattatgtcatgggcttatcgccggagagggggctgagattcagggggatgcctactttaccgcatttggcctgcgtaatgtggatactgaatcctactacgccctgcgtcttgcccgactaatcggctgcctgtggcagcccgcacgtcaaagcaacagccagtatcatggacaagggatcggcctggctgtgagtggcaattttaaacagctgctcaattactcctacaatagtgcgctctggaccaccatcattgatcctaaagtcaccctcgactttttcactagtcagaaagatgtagtgctcatccactattctgaccaatacaccagttgtgcaggctacgatgccgtcaccgtcacgaagcaggttgatttgttcctgcggttgcttcagaccggaaaccagtcagggcaacctgctgttgacagtcagcatttgctggctgaatttaacgcctttaatggcgaatggttgctgaaaatgctgcgctccagtgaaagggagcggaaagagaaacacggtattataggcgcgtacaaatttgtgcaatccatgctgcaccagtccgatatttgctggataccattatcggtggccgaaatgatccgcgtttccggcaatgtcggcctgaaaatgaaagagagcgatttatcgagaaatttacagggttatcgtaaaggtgctatctctgatgatgtgctctttgttggtttcaaagaaaaccgcctctatctgttgccgctggaagttaaaaccggggcgcgtcctgattacagctatgcaggccaacaggctcgtgagctcaaacgttatttacagcaggacattctggaaccacaaacgctggcatcacaattgtaccgggcgctctttattcgtcaggtgctgatgcaggtggagaaactgcgcctgtatggcgtactggacagcgaaaaattgactcccttgctggaacgacgggaatggtggttaacgggcgactatcagttaggtgagttggccgactatgcggacggcttcgtcgtggcgcatgtagacagcgcaacctgtttcgatctctcctataaagagacagcggagaatatcttacagatcgaaatcccttattcactgctgccttcgttgattgctgcgcaaggggatgaaccaccgttggcggaacgttaccgggtgccggaaaaataccggcttaagccagcgtgtgatgccagtccgtcacaacccgaagtcgtggtagaagtcacaacgccgtctgctgcacagtccatttcggaacctgagtcggagtcgttacagcctgctgtaccggtggtgacaccagatattagcgatactccattacagatcctgtttggtcatgatgctgcgcgccagagcccattacattgggagccaaccaacaccgccaagttcatgaataccaataccggcattattggaacaatgggcaccggtaaaacccagtttactaaatcgctggtcacacagttgatgcgtaatcagtcttgtaacgttgatggtaaacctattggtttgctgatcttcgactacaaatccgattatgtggatgaggcttttcttgatgccacgggtgctaaaaagtacaagttatttaagctgccttacaaccccttatctctgtttggcgacacgccaatgctaccaatccatactgcaggtggactatcggaaacgatggctaaagcctatgggctgggccataagcagcagctcaaattagaaaatctgattttagaatgctacgaagcagcggggatttcacctgaagatccgacaacatggtcaaggactgcgccgacgattgaagatgtatggcaacgtttcctcaatcaggaaaaggttgaagaagattcactttacgcagctctttcaaaactggcgcgttacaagatattcgagactatcccggagaagatgaccagcttgtacgaattgattgacggcgtcaccgtgatcgaactggctggttacccgccagaagtgcaaaacctggtagtcgcgctcacgctggatctgttttacgcgcagatgcaaaagcgcggtaaaccagtcgtgcggggagattatcgtcagctcaccaaaatgattctggtggacgaagccgataactttatgcgtcaggatttttccagcctccggaagatccttaaagagggccgtgagtatggcgttggtgcgatcctgtcaactcaggagataacccactttaagactggtgaaaataactatgcctcatatatcttaacttgggtgatccatcgtgtttccgagattaggaatgcggatattaaggcggtatttaacgtcgatgataaaggtgagcaggagtctttaatgggaaagattcggcagcttgagaagcattttagcctgtatgtggatggggataagcgggttaagaagatgcgtgatcgggcattttgggagttagctaaatgacaattattgaagctatcgtaaatgtattaaaggagcatggaaaacctttatcacataaagatatttatgatttcatcataaataaagaatattactcatttggtgcaaaagatccagtatctgtagttcgtggtgaaattcgaaagcattgttatggagttgatttcccaagtgcatcaccacggaaaatatttattgaggttaaatctgtagggcaatcaaagccactatacaatttatggcagggacacgtatcaaatgctagccctcttaaaactgaaaaggtaacaaaagatcagctaccagaagagataattcatgggaagtatattgaacatattaaaaccataaaagagcaattgcttgatgctattaattcttcggatccagctttctttgagagccttgtagttacacttctattaaaaatgggttatgggtggcacgagtctgaggcaggtaaggtagttggtggcgctggggatgagggcatagatggcattattaatgaagataaattaggcttagaaaaaatatatatccaagctaaaaggtataataataaaaaagtaccatctagtgaaattagagagtttattggctcgatgaaccaaaaaggagcacacaaaggggtatttttttcatcttcatgctttaccgaacaggcaattaatagtgcagaaaaagcacaaggcatgaatatcactcttgttgatggtggacagttatgtgaatatttggtccaaaatggcatgggggttgcaaaggtaagtacatatgaaatttatgaaatagataaaaatttctttgatttataaagttaatataaaatggggtctcccccattttattaaatttgtttttttatctcgtccttgaaatctcgtattttattgaagaaacagttttttatcgtatctaattcgtttcttattttcccaattttatcagaaatctccttgcatttttcagtattgggattttcatcgcttgtttcaaaatctattataagcttccttagttctacggttttttccttataactatctacacattttttaggttcaaaagcgcctattgaatgtaagaggctggaagccatgttttgttctttaaaagcagggtaaaccttttcagaggactgtttttctttatcactaaagcttccatctaatggtttactactaggatcgctcaatgttttatactttctatgtttgttcgaagcatataactccacagcatcggaaaataagcaaaaacaatcgaaggctttatataatagatctacttctttttcataaactttgctacgagcagtttgattaggtgttttaaaaaaaatataacaggttaaaagtattattgccacggagctaattaaactccctatggaggtcacgtaatctacccaatctttggtggtaactatttctgttagttctttgatctgatcgaaagtaatttccattttatttccttaatagccagtgcataacgcactggcataatagttatcattacaatgaaattaacaagtctcttaaatttcgatggtttctaactgaagcgattccatcctcaacatgtgctgcccatgctttaattatcaatttttggtcgagcttaggataaagcatcttcaataccaattctgtagtctgcaatgtttcccccagccacgttattttatccagcaccagagagccatccagcttcttactatcccgctcaggcgaataacgaaactcactctccaccgagcggaaaaatgccagtcgagccgcgacattgggcgtaatcccagtgtatccctttaactttttaagctggtcttcagtttgacgactaagcaccattcgattcgggagcatcagatagcctccttagttaattcccaaaaataaccaggtttaagcgtagatgattttgaatgtgcattaaacacaatctcataagcatgcgaaatatcatcacgtaactgatcgacaaaataacgctcatccacttccgtatcggtagacagtagcactacctgatggctggcaaacgggaaatagtgattaatcaacttatctctatgttgggaatccagacgccctaatggagtatcgataatcaccggtaaatcacggcctgaggtttttgccaaagcctcaagaatcgcaattgcataaatctgcttttcaccagcagaaagtagcttacggtttatgacggaaccctgttcattaatcagctccacgtcaaacgtttccgggttaatatgcgcgctaagttgcaaatcttctttacgggctaatttgcgataggcgctttcgaaattcgctgacagtgttttcactcttgcctgtgttaatacatcactgtatcggtcgagtaaattaatcgtttcctgcgcgtttttaaaggcgctactgaagccatgctgactgcgggcaacatcatgcattttttgtacctgacgtacgcattccagttgctgttgcttaacctttttagcgtcttccaacaatgaaagatatttttgccgctgtttttcacgttgtttatccagttcgcgtagcttctcaaagagatccattaactggtcatcttctggggcgcgggcaatgttggcggcagcttgttctaattgctgttcaatctctgataactgggtacggtaaagatcgaaacgttgccatgcctttttgctgtcttgttcaatcgactgctggagcataccggcttcacgttcagagatatcaaacaacaaatcgcctttaggcttggttgccatatactctttcaaattatcggtaatcgcttccgtagcaattttactggtggtactagaacgcaatgcgatatcgtttttaagctgagctaaaaactgttccagctctttttcaaaactctgagtttgcttaatctgagtttcatcagcaattttccccagcaaacgagctaatgtcttcggggctagcgcataaggtagcgacccatcacattcctgccgcagtgctttttccagacgctccttatctttcagcaaagtatcaactttctgtttttcttgcgctttagtctgagcaaatgcgccgccctgtgcattcaataaaccttcatagcggattatatctttagacagaaactcaatccgcgatttggcaaaatcggcgctttccagtaattcttctgtctggcaggctaattctttactttgtttttcaagctctgcaatctgctgttgttgagatcctactaactgattggattgctgacgcttaacaaaaatcattaagtcattgcgtagtttagaaattagatccaggcctaataaacgacgcacggcagtgcgaagaatattgccggattcatcttccgccagctccgcaattttctcgccatcaaaaaagaacagatcggcaatgccatgcggaattaattcattaagaaacccctggcactgatcgtaatccagctcactgagtggcaccccatcctgttgcaaagaaaggcggtctttcttcccctttttccatgctcgcgtaacggtaaactccgcttcatggccgcctttattgtaggtaaaggtcaattcaacagccgcttcttcaggttgctcactatagtacgcgccgctgtgaattaacgagctaagctgttcaatatattcctgttgctgagtcgcaagtccaaatgccagccgaccatacaacgccagacggatcgccgacagaatcgacgtttttcccgcaccgtttaaaccaccaaacagcacaatagggcgatgattcacttcatgtgggcgctttcttggagccagatcaatggtgtgagtaccgttaaatacccgaaaattatgtaatactagttgtttaatgagcacgttcgttttcctcctcgactaaaacagaggattcgcttgaatcgacaattctgcgctgtagaacctgaagttcagcttccagcctggtgacttcttcctgatgaatatcccggtcgttacgtttttgtagcgctgcctgttgctgctggatcttttcgagactgccccaatcctgttttagaattgtacctagcttgtcaaaaatcccttggcgacggcttagcccttccattgatacttccagttcaattagcttcatgaccatttcgggggcaacgtcaaacccctgagctatctgcaccaataaatctgcatcgctggcgtcaaagcgtgattgatcatcaactatccagtccagatcccgctgataaacgtcatggtaaataccgggtaatgtgtcataccagtctggttcattaggatctttcagccattcctgacggatagcgtgcagctccggctgggtaattagcgtaatggtatggccctgggcattcaaatcacgctcaatctccagcagtgttttcagccactgctggcgatacttcagccagtaagggccgggaacatgcttacgttcggcactaatttcttcgccatctttggcatactgataactgaccttgccagtacgacgcttatagttacgaaacgtatctttatttactgggtcggtggtaaacgccagtagatcgcgatatttcagcagcggagacatccactcttcgccattcttaatcaggctctccatcgctttatctttggtgactacggtacaggtccagcagccaaagcgggagttaccacaggaaggggtgctttcatcgatcaccagtggacattcaccctgtgcggaagagtccatatacagcgtccacagcggacggttgtttccgccccacgggctttcccattcgtcgatatcttcaggggcataacggaacgcgccgcgcaacagcttccagacgtcttctacatcccaggtatcaataggggtatagataaacgcatttgccagcgtagtatgtcgggccaggcgtgagccatcaattttgtgctttgctatgacctgcgcacgggaggcactctcgctactacgtgagccaaggacaacaatcacttcatcaaactggctgaccttatctttaataaagtcgctcaccggattgattttcatacgctcggtacaccagcgaaaactacgggttggcgctggataacctttcccaagcagatttacccagaaggtttcattggtttttggcgtaaccgcatgctgagtgataggaaggccatttcgtttagctccagcctctatctgcaacatggttttttttatcagatcaaccaccaccggtgtttcaaccagcgtatcggatgacaccaaaaaaacatctttgctgcgcatttccggaggcaggccgagcaaggccagatacaccagcgtgatcacagcggaagaatctttcccgccgctgtagccaattacccacggacgcttatccgcacaataaattctttgaacctcagcaacatattcggccagagggcgtccagcgaactgttcctgattaataaaatcttcgtattcggccaaatcgtaggcctgaactaatttactcatgagacaaccatttgagcttcaagctcctgttcttcaggagtgagggggattgagagcgcggtttttagcgcattacaggttaactgaatcgatacgctagtcttgctcagtttaccatgctgcattgctcgcttaatcaattctgggttgctttttcgccagtcaaaagtcttgagcacagcgattctcagctgccagtgttctggttcttcagtcaggagtgagcggcccaacattcctaatgcctgaaggccaataccatgcgcgtgtacataatcttgtctcaactgtgcaggtgaaacttcttttctggcagcaagttgccagtctggcataacctgagcgatcgcctgccaatactgcgtagcaatatttgtattctcttcaagactgccatctttgggatctttacctagcagcgctcgtgtcgcctgtttgatactgcttaaggtaaacagcttgtttgagagcgtactgatgctagatttttctaactctgtaagccctataaatggttcaactgacatcgctagataacgtgcaagattagaactgatgtcgcggtgatcatacaacgttgataatgaaggacttggacggatcgcgtatttgttcaagtctgcgaacatttgctgactacgttttaatccttcgtcgacaaaaaagagcacagggatattatcctgtcctaattctggacgttcttccagcgcgttttcaatggcctttcgacgatgttgtccatcgtttatgagtatctgtgcttccatcgggacgcgtaacattccgaggttatttgagccaggaaactcatcaaattggacatcaattgctattgatgcggttaaggctgaaaaaacatagtctttcggattttcaagaagatatctcaccatctcggggattcgagacttatttaggatacgctgagcccgtagctctggtgggacttcattctcatcgaagttgaagatcttaggtatgattcgcatagggcaggtagcgatataaaatgggcgacctgcctgaatcccacgcacagcagggaatgagtaacaataatctgcgtcaaaaggctgcattgttatgtccctttaaaatataagaaaatgattacgtaatattttacgtaatcaacaggcatttttgaatttttttaacgtaaataattcttttttatagtaggtgactgactttgttactatatacatgtattaccatagacttttaccttggcatcatcctctctacttgcttggcaccgttcttaacatctttacttcccgcagagatgacccgggtcacagccacgacaactctcacccccgcccatgtcagcgccccaagccagtacgcaggcagcaccacaaacatggttcccatcacgatcaaatcatcagaagtgttctgtaagccgtacaggtagaaatgcgaagctctcgctataaatcatctccatcagccagctatccaaccaaccggccagctcccaccagaaggtaagcaagaacagggcgaattgcacgaagctcagcgtaaccacggtttttaattcccacgcagagaacagcagagtcacaggaatacaaatcacaagggccattccaaggaatgcctgcagcatcggcaacgcctggcgcacgctgtcgaaagcagggaaaaagcgaggctggaaaccgacattccggcgatactccccaaccacttaatgcttgcgatgcattcaagttatctcccgcattcccgccaaacccgttgtacactcgcccatcctgcgacacctgcatattgcgtgggctcaccattgagcgtagtaccacttcttcatattcctctttcgactgctccagttttgcagccgctgccagagcgtcgtatcgacctgcttcagtagtcgatttttcagccccgcatcatcatcggaccaccatttcttacacactggatagccaccaccacccgtatcacccaaaccgtcatcgcggctggcgtcataaggccaggcggcgagcgcggtgctgaacaggtcggcaaattggcatcccagcgccatcagtttggtccaagcctattccgccgcgctgcgtagcgccagcaggcggtcgataaccttatggataagaccactgtacagcgcgttgggaatgcagggcagcagccagtctacggtctgtagtatccggctgatttgcgacaggctgacgggatagccatcgcgggtgagttgctccgctagcgtcaattgcgtcaggcatccaatgcctgcctcgtggtaaagatcgcgcagatgcagaataccttccgcccgttcgataaacatcaatccgttatgcagatcgctttcctccagatggtcgagcaggcactggaatttgccctgctgcgttgacagcgtttcgggccgcggacgaaacggccagcagacgcggtggtaacgttcatcctgcgtctcctgccacagttcattgaggatggcgaggcgcgtattcccaccgctggcgagcatatacttttcatcaccgggacgacgggtcaataccggcgggttatccagcccacgggtgtgaaataacgctttcagtgcctcatagccggggttgcggatgacgcggggattgaggcgaaacggctggatttgctctaggctgacctggaccatttcctcttttccggtagtgctggcaccgtgaagccagcgattcagcaggtgtgaggcgcacataatcttcctcaggtattcagacatcacgggtaagccggatgcgctggtggatccaggcatccaccttgctttccagctaggcgacgtggcggctgttgagtcggatggacggcggaaactgttgcagctggatttgccgataaatccatgatttaccgaagccgattttgtcttccaccaggcgtaagcgtaaaaatttgccgctattcataatcattccttctatgtccagattcgctcacatcaacacgatgggtgtggttatcgaagaagcagcgtccctgccaagcagtaaaaatccttatctgggttagtgagagttgatagttgaaaggattagttgattgcgttacggcggtgcgccgcgctggagcgcggtattcagcgcttcggggctcagcggcaggtgcataccatcctcacgtgcccagcattcaaaaatgttcagcaatttgtaggaatgctccagcatttcatctttcagttgcgggttgtgcttgcagtccagccatagaaaacgggaaagcgtggaagtgatccgctcttttgattctggttgatagtgatccaaaaaagcctccagctgggtatggcggatgacgaacagtgcgtaaggaggtagcgtgtcctacagggagcagtcggacagactgagccgggaattaaggtcattggggccattaccatggagttggccaatcagcagacgcagctctttctgaagattgttttgcgtggcgagcagttccagtaaaagccctcacaacgatttgcggcagcagagttagtagtagctgtcattcttatcgctgaccacaatgttaatctggttgcatcggggcaaaggcgattcaacattttcttcagatgctggtggagcagtaggcgctcaaggccgattaacggcaaattccacaggtagctggtggtcagtagcagagtcgcgtcgcgtctgccggcgacatgtttaccatcgctttgcagttgccgggtttgatgcactacgaaggtggaaagagagatttattgctccggcaggcaaagcggcaaggtggattgagtgatttaagaagtacgggcgaagggaagtagactgagagtggcagatcgccgtgcagggcatggcggatctggtcgacaggcagcaaagtgatatcgtgctgtcggatgacttctgcggcctcgtccagcgtcagccactcagggtggattttgtgattaaccataaattacctcttttatttttttgtaaaaatgatgatttttgcgtgatccctcgcaatgatgtcacctataatgttgataattatatttttttgtattacatgtagtgaacattcattaattctagcttaggtctggggatggccactaacccttgggcggtagcgtgactattgcaaatttgaatcgaggtcaaaatgtctactaatgatgcattcggcatttttaatcaggaagatatatatttcttcaaaaaaacaggttcttttggacgtttttctacaataaatagttttccaattgagtattttttaacttcaatgaaggccagtgaattacatcaattgacttttgctagggaaattaagcctggggataaaatagactttgatcaactgttacagcgggatttagatttggttagagtagaaactgaaattaaaccttatcttacaaacaacgactctaagtcaaggacaatattttttccacctttacttgttgccgcaatcccagtatcaaaaaatacaatggaagaatattatagccagcagcaaattgataaaatatctataggggggcgtgaaggttatcttaggaaatgggatggcttattcaagcttactcatttagaggatcgaaattatacaatcacgccgtccttagcggataagaacaactcaattaacgtagcaagagaacctactcaaattgaaattaatctatccaatgggattgaacgagggataaaactaatagtcatagatggtcagcaccgcttaaaagctcttcaggaagtttatgctgaaaatggagactcgttgagtgaaatggctgtacctgtatgtatattattttcacctgactcgactttagaggtggctcagtctgtagaacagactaaacatgtgataccaaaagttccagagatatttagacagttatttgtcgacgtcaataaaaatgctgagcaggtcggcgggcattttaatatcttgctttcagaaggcaatatggggagcctaatctgtcgaagtttttgttcctttgtcttatctaaaagaggtattgagggacttgcacaaattgaatggaatcaaaagaagaagaaactctcaacagaaattaatcgtagttactatctgactagtattggtgtaatagaaaaagcgttggctgaaacattcggtaaaaataaatttgtaaatgagtactttataggttttgatgaaattaaatatatcgttcatccatctgaaaatgatgaccatctagaatttccaaaggtttcatgggataggttttcgttgtcacaaaagaaacatattttatctcaaattttgaaaaatgttgttccactattagaaagattatttttcgaaagtaatctctttaagcctgcaaatgattgttttattaaagagatagctcgattaagggataagtccgaaacagactctcatggtggaattgcatttaaacctgttatggaaaatttactggaatatatgccaattccagatactgaaagatatagagatgctagacataatctaagactatttgaagaagatgttaaaaactgtaagaaagaacagtgttttacctttttaaaccatgcaattttccaacgagcaatatttttggtctggagtgacatattaaaaataggaaatagagttggtttaacaaaagaattttcaaataatttcttctttcaattgattgatgaacttgataataaagttgatgagcttattgacttcaggaaaagtttttgccaaaattttatttttctttcaaatagaattaatcctactaatgaagtgcgcaacggtatatcatatttaattttatcaatgctttctaataaaaaagtacgtgaacgattatcagcttctgtaattaataccgataacgataaacttttaaattcttttaatgaagaattaaggaatttatcttattcttgtcttaacaagtatatggcttcatatcgtaaaaataagacaaaggtatttaaaactaattatccaatagataattcaatagataatgagttacgaaatctattacaagaagaagaaattaaaaagaaaagagaaatgaaagattataaggacggaattatctctaaagatcaaattactagtaaatttgattttttagtggatgattatgttaaaaaagatattataaatgtccaaaatgatcttagaagtgctttaaaccttgaattagatgtgtttggtttaaatgatatttctccagagttagttgaagaggctagtgagttcgagtctttggatgaatgaattctatggaaatgttatgtgttaacctcaatagattttataatgactctgatgtttttgagatcctcgaggaggatctcaaatcaaaagtagttgatttcatcataattaatggagataaagatgtatataataagatagctagttatttaatatcacctaaaatttatgttggtttttcaccattaaataaaaatgatttaaatgggttgtgtttgttattaagttatcttaatgggggttcagactataatttggatttttacgaggaagataatattcagacaaaggagcagaatccgttggctgcatcatttattgattatcttgaatccaaagatattgaatcagtcatatacaatacccgagagattcaaaaaaatataagtctatattattcttcaattccgaatattgaaaagaatctaaaaccatacattgattataacattgttattttttcattgtataaaacatctattggtatctgtcgttacaatgagatggaaaaagatctgtataggtcattaagaaacgcgacaatatccaatcgtttaaatgccgcattgtgtgatgcttataaaaactgccctgatttgtttgatatagtaaagtgcattgaaaattacctagtaatggttaaagccaataatattgatgcattaattttttacgtggcattattcttgaatttatctttatttaataagaataggaatgaatattgtattgcttatctttatttgcagagggctgtggaaacagcattaatttaccactatttggataataatgtaattgaagtaaatgattatggtggattgtctttcaaaggtgatgttaatgaaatacatggtgttggtgagttgattaaggaatacttttccagaaggaaagataatgaattgagcaaaaaaatatggaagctaaactctttgagaaataaaatgctattggctcatggttattacacgccttcaggtgtggactacgatgatttatattgcgcggttaaagaatttgttctgattattataagttcagatgagtctaaagctttttatgaaaaagtattgaatggattaaaacccattggtaaagaaaaaataaaaacagagttatcatttgctcttcttaataattaaatataaattggttattttttaatatctttgttgaggttctttaggtatgctatatttaatggatggtgaaatagtaatttattcttggggatttaatggataatacaggcatgtttaacaacttaaatataattttcttgaccatgaatattagttatagttccagcctgcgcagttagagtatatgcgtatggttaaaggttcggaatggagagaatgcatcggcattcatcacgagtaaacgtaattatattcattcaatcctttctacaatatggcttaagagaataaatgccaccttattatgccacttctttggattgctgctgcaatagttaacgattaaacatataggtatccctatgcttcaatctctgaaccacttaacgcttgccgccagtaatttgcagggcagcctgagcttctggcgcgatttgttagggttgcagctagatgctgagtgggataccgacgcataccttacctgtagtgacctttggatctgtctttcttatgacgtatcccgtaactacgtggccccgcaggaaagcgacgacacacattacgcactcaacgtcacgccaaaggattttgagccgttctcatataagctggaacaggcgggagtgacattctataaagacaacaaaagcgaagggaaatctttctaaattcttgacccgaatggccacaagctggagctgcatttgagaaatttagcatctcggctggcgcaatgccgggagaagccgcattctgaaatccgtttcggtcctggaaaataatcacgcaattttctgatcttccatgcagtattcaattttatgcctcgttttggggcaagctctcaaaataaaatctcataatccattaatattaaataaattaaataaaggaaaatcccgccttcgtaccactcaaagccgccaccggcggctttaatgctcttacctcagacccactatgcttcactctttcccttatcaccaactcctctcatcaacccccgcctgtccaccttcttcccatccttccccacatatctttcgggccatatcacgctcggatccacccccagcgcctccgcaatcaaatgctcccctttaggccacggacgcgtaagcgcattcgccagcgtggaggaactcaatcccgaagcgcgcgacagcgctgccagtgacgttccttttttacgtaagcctgcgatgatatctgccgaatgccaacctgttgtcataatccctcctgacgtgtcatgtaagtaaaaccgttaccgcataaatgctacgttattcgtagtatggagtctaaacctaaaactacgaatttcgtagttatgcggatcgaccgagatttttatgaaatagagtgcaaaggctgtgaggtgtatggaaggcgctacgcaatattgaatttctgaaaatcacagcctttgcgccagaccagctaactgcctgaactgaaatcaatactacgtttctcgtagtatctgccggctggtaaaactacgactatcgtagccatgaaaattaccagcaattactccgacatcttttgccagcgcctcaaggcagcgcgtctcgcgaaagggctatcacaaaaaagtcttggcatacgtgccgggatagatgagtttgtggcgagtacccgcatcaatcgttatgagaagggcgtgcatcaggccagtatcgaaacggcgcagcagcttgccgccgcgctggaggttcccctcgcatatttctacatggcagatgatgagttagcagaactcacacttcattgggctacgctctctggtgctgacaaaacgcagatccttgctctggtaaagagcaagtccggttaaacctccgtacgtctttacccccgccccacaacccccataatcacctccatcaactcctcaaccgccgcctccgcatccagttccccggtcttcgctgcatagctcagcccctcggcagcaccaaaaatcgcccataaaccggcatcaggcagcgccttatcaggagagaagggcagcagaaggtcgcggcacaggtgcacgaaatcccgcgcgtattccagcttaaacacctccatttcgggcgatgcgctcagcgcggccagcacctcagggatctcaatgccctgggtcagcacgcagttgatgtacgccagggcgatggcgctggctttgtcgtgcaacgtcgggccgctgcgggaaatcgactgggtaaagatctgcgcctggcgcgcttcaaagtcccggtacagcgcaataaacagcccggtgcgggagccgaaatggttgtacaccagtggcttggtcacgccggcaaactccgccagcctgccgggcgtcagggattcggtgccctcctgaccaataagtttccaggccgcctccagtaattgctcaaaacggtcttctttgctcatgcgcttttgcgtcatcgtcgggcctcctgttgacaacggcatcatccatcgctaagttaccattagtaagttactaaaggtaacttcagattcaagagtaaaagagttccccggcagaagcaatgaggaaaacctatgcaaactctgatcgtcacctctcacccgtctctcacctcgctcacccgcagcgtggcgaaccatattgccgacggcatcaccagcgccgacagggcgcattgcgtggagattgccgacttacatcaggagaacttcgcgccagcgtatcaggaggtggattatcaggcgttcagcggccagcgtgcggtgcctgacgacgtgcgccgggagcagcagcgcatcgacgccgccgacaatctggtgctggtgttcccgatttactggtggtcaatgcccggcatgatgaagggctggatcgatcgcgtgtttacaaatggctgggcctacgaagagtcgcccgacggcaagctgctgaaaaaactcggtcggctgaacgtctggctggtggggctgggggcggcgacggaggacgtctatcagcggcacaactactttgaggcgatgaaaacgcagctggagcacggtatttttggttactgcggcgcgcagttctgggcggcggagtggatgctgccctcgcagttgccgcgtccggaggattatctgaccgccgcccgcgaactggggcagcgtatcggtagcggcgcgcgttaaacggcaacccccgtcgcgggacgggggcgttgggttattttttgccgttcggttttaactgttcgcccggtttgagtttgaacagctcatcgtcgcgggtggagtagcgcaccgtgccgtccgccagcagatatgcgccctcggtgaagccagcgccgttaaggaaaggagccaccgcgtcgggctgattacggaaggcggcttccagcgccagtagcgcataaggcgcgatatggtcgatgctggcgaactctgcctgcgggtcgtcgacgaagaagccgttcagacgacgggtattcaggatgttggtcgccacgcggtccgccagcgtcagatagtctttattgccggtggactgccacagatcgataagcgcgaaaatggcgtacggctcgttgttatcggtgttcaggttcagattagtgtccgtgccgcctggcgcgccgatgtcccccagcccctggccctgcgcaatgccgcgcgccactatccacatcgccggatccggctccagcgtccaggccctggcataggtgagcagaaactcgttgcccgccgggtagggcttcaggatgctgccttttttgccgtagtaaccgtcacgttttaactcatagcccgacagatccgtgccattcgccagcatcggacggaaggtgttggtctgtgcgtcataggcatgagtggcgaaggctttcaggccgtcgagcgtccattttttgatgtcgtcgccatccttaccgagggattttgccagcgccagctgcatcagcgcgttctcggagtaaagcgtgctggtgcggcctttcagcatcatgttgccttccagcgcgtcggcacccagctcaggcccgaactggcgccgggcgcggtcgccgtatttcgagttagtgtccgtgtcgtcggtggtttccgcgcgtttgagcggctgcgtgaactgataaacgcccaggccggtctttttatcgcgcggtaacacatactgttccgccagacgcttcgcccagcgcagcgccccttcatcatgatcgtactgatagagcagcgaggcggagtagatcagatcgtttccggcattcaggaagctcagccctttggtggcgaaaaacggcggctgttgctcaaaatcgttctcccagagcttgcccatcgctttgccgtattccccgtggcggctggtttccagcgttttccagtcgttaacatgcgcattccagaacgctttgataaagcgcgtggtggcgggtttatccacggcaaacatcagatcgtaataggggtaagcgtttttcagctcatgaaccatctctttttcgctcgggccttccggctggagcgttttcagatccacaaaacggtggccgccccataacagcaggccgctggcatcctgataatggtcgaagtagtagcgcacattgtcttcggcacgctgtttatattttgcgtcgccggtgagattgctcaggccgaccagcacgcgcatcaggttctgctgggcagagaagttcgacagcacggcttttttgccgtccgggaagatccactccatctgtttgccggtgcgcggatcgacgccgtttgccagcagcggcacgttgtgcccgtaattatcccccgccttatcaaagacggtgtccgcgaacgttttaacgctgttcaggcgttcgctctcctgcgccatggcgtgagcagagaacagactcagacaacttatcgccagtgctaatcctgaaattttcattatttgcctctcagtcaaataagggttttatttttatgctgctgcccggatgtcatcagaaagaatatttcacgccgacgcggtaacgggtttgtctttcatcggtaaacttgctgccggaaacattaccaatcgccatataaggggaccagttcttatcccatttgtaggtcagcttaaaatcgtgcgtccagtcgtggctatcgttatctgccagcaccacgcctgcggaattcgcttttttataatccagctcataatccagctgatagtctttcaggaatttccatgacagtacgctggtcaggttgtagccgttctctgaggtgtctttctgcgagccgatattgccggagttacgcttgaagtaaggccggtagcgcaatgacgcgctgacgtcatcggtgagattggctttgccacgcagatacgggcggtaattgttggatgacgagccggtatccagtgaaaagcccggttctatctgaaaggttttattaattttatgaacgtagctcgccactacctcggtgccattactgacggtttcgtcaaaggctttgtctttatcctgggaacctttccatttcccttccagcgataagccaaaaccattggcaaaacggtgtgataccgccagacgatctttatgattattcccgccgctgtcgttcatttcgtgacgataatcaaaggtcactgcctgagccgcaatactcacgaaaggtacagttaataataacaatgagcgcaacataggatcccctatttttagtagtccacaggtataagatgttctctgccagtcagcagtttgaggttattttgattttgtggaatagacttttgcacaaaatgaaatggcgttttgagactgcgatcagagtattaaaaatgcgcctaaattaattaacatggcatttgtaaagatattcctggtgatttatattcaataatatcaatgtgataacttgctggtcgtctatttttacgagccgaatgaacgtggtttacagtagaggtcatgtttgacaataaatttattcctggataataagttatttcgcatttgaaaatagcgtgtcatggctggaggcataatattactggtatagagacagcaaaatgtcatcccacgctaacttaaacaaagcttaaacaagcaggaacatcacgccgatggcctgcacaaaattcaaaaaaagtcttccatgcagaaggccaataacaatattacctctggagcccgaatatgaccgtctacggaaaagatcgtttctacatttacggaatagagaaaatccttaatcaactgtaccaggagcggggcggggggaaccgtgccagtccgtcgtgcatctatgtcacctccggcatggatattgtggagatctacgccctgtatttttcccacccgcccgttcaccacgctattttcattactgacgagcgccatttcgacgcgataaaccgtctgtttcccggactgataaaactgagtctggcggaaaacctcggcgtggaggagctacgccaggcgctgaccatcatgctcctgctggcggagcaaaatcagcgcgcgggctaccgtgccgcgccctttaaatttactgccgccgagcagcagatcatgcgcttgttactgcgcgggcattcgctggaggagatcgcccaaatccgcggcgtcagcccgaccaccgtcagcgtgcagcgcaatggcctgatgaaacgcaccggcaccaaaagcctgcttgagctgtgttcgctgtacagcgccatgcgcatcgggcagcgccacgccaacccttgacccatgacaaggcggccaggcctgcgccctctttataatcagggccgtttatcttctcgcaggcaggatcgtatggcgtaccaactgaatcttaactggccggaatttcttgaaaaatactggcagaaacaacccgttgtactgaaaaacgcgttgccgaattttgtcgatcccatcaccccggatgaactggcgggcctggcgatggagccggaggtggacagccgcctcgtcagccacaagaatggtcagtggcaggccagcaacgggccgtttgaggatttcgacgggctgggcgaaaccggctggtcgttgctggcgcaggcggtgaatcactggcatgcgccttctgctgaactggtgcgcccgttccgcgtgctgccggactggcggctggacgatctgatgatctccttctccgtgccgggcggcggcgtggggccgcatatcgatcagtacgatgtgtttatcattcaggggatgggcagccgccgctggcgcgtgggcgacaagctgccgatgcgtcagttctgtccgcatccggcgctgctgcatgttgatccttttgaaccgatcattgatgaagatctggcgccgggggacatcctctacattccgccgggcttcccgcacgatggcttcacccatgaaacggcgctcaactattccgtgggcttccgcgggccgaacggccgcgatctgatcagcagcttcgccgattatgcgctggaaaacgatctgggcggcgagcattacagcgatccggatctgacctgccgcgagcatccgggccgggtggaagagtacgagctggcgcgtctgcgcgggatgatgatcgacatgatcaaccagccggaagatttccggaactggtttggtcgctttgccaccacgccgcgccacgagctggacatcgcgcctgccgagccgccctatgcggaagacgagatcctcgacgccttacagggcggcgaagtgctttctcgcctgagtgggctgcgggtgctgaatatcggcgggcggttcttcgtcaacagcgagccgctggacaccgtggatcccgtcgccaccgatgcgctctgccgcttcacgctggtggggcaaaacgagctgggcgatgcgctgaacaatccggcgttcgtcgccgaactgaccgcgctggttaatcagggctactggtacttcgacgaataatcccgccatgcccggcggcgcaggcttgccgggcctacagcaatgccttcccctgtaggtcgggtaagcgcagcgccacccgacaaaaggtttcacgcctcacgcctccagcgcaatctgcaccgcttcgccgagctgcttaagcgcctggcggtgacgctcgtcggtgggcagggcgcagttgatgcgcaggcagttgcggtatttgccggaggcggaaaacagcgagccgggggcgatctggatcttcagccggctcagctgttttgccacgcataccatgtcgaccgtctcggggagttcgatccacagcataaagccgcctttcgggcgcgtgacgcagatttcacagggaaaatactggcgcacccagcaggtaaaggtgtccatattatgttgataggactgccgcatacggcgaaggtgacgatgataatgcccgtcgcggataaaagccgtcatcgccatctgtgtggtgggcacattggtgccgctggcggcgtatttcatatgcaatacgcgatcgtgatagcgtcccggtgcgatccagccaatgcgcaggccgggggcgatagttttggtaaaggaactgcatagcagtacgcgcccatcaatatcaaaagacttcagcgtgcgcggacgcgggtaatcaaaagccagttcgccgtagacatcatcttcaaaaatcacaatatcgtgccgctgcgccagggtgagcatcgcccgtttgcgcgcgtcgggcatgacaaagcccagcggattattgcagttgggcaccagaatgacgcctttgatcggccactgttcaaacgccagctccagcgcttccacgctgatgccggtatcaggatcggtcgggatttcaatggctttgatacccagcccgcgcagcatctgcatggtgccgtgaaatgacggcgactccaccgccacaatgtctcccggtttacacaccgccagcagcgcaatggccatggcgctgtgacagccgctggtgatgatgatttcgtcggcgctcagcaccgcgccgttgtcgagcatcagccgggcgatctgctcgcgcagttcacgccgccccgccaggtcatcgtagctgaacgcatcgtgcttatggtgctgcaccacgcggctcatctcacgccacagcggtttcagggtggcctgggctatgtccggcgcgccgccgccaaaggaggtgatggcgggatcgcttcgcgcgtccagcagcgtcagcacttcgtcccactgggtgatctcgaccggacgctgtaccgggcgggacatcgccggtaccggcggctgtactttgcggggagccacaaaatagcccgagcgcggctgcggcacgatcaattgaagattttccagcacccgataggcttcctgtacggtgctgatgctgacgccgtgctcctggctcagagcgcgcacggaaggcagtttttcgccgctgcggtataacccctgctcaatgcgttcggccagcagattggccagatgttggtaacgcgtcatgctgtatcctttatcagacccgtacagatcgcaagaccagtacagagcagcggcaaaaatgccattcaactgctgttttagcggatctgtatggttaagaaaagcattttgtgcatctgtattgctggccggtatttccccatgataaggctctgttccggcgaggagagcaatcatggaattctttgaaaaccgacccaaacggccttttatcggctttgttctgatctggcgggcgtttaagcagtggcgtcttcgggcaaggacgcagcgcatactcagccagatgagcgaagcccagctgcgtgatgtgggacttaaacgcgacgatgtatgctgatgacatagcccggcggcgagcgctgaccgggcctttttttaacgtctttatgtgatcacgatcactttttcgcattccatgctctcttgttgccgctttcttgatccttcccctgataaccattagcttagccggctgcccgtctgcacagtaaccacgaagatataatgatgatgacgcctgaacaaaaatttgcccgctgggtaagggtgagtattgcctctttcctgctgatgtttgtctattttattgtcgcggatatctggatcccgctgacgccggatgccaccgtgatgcgggtggtgacgccagtatcttcgcgcgtggcgggctatgtcgcgcaggtgcacgtgcataacaacagcccggtaaagaagggcgatctgctgtttgagctggatcccacgccattcatcaacaaagtggaagccgcgcaaattgccctgcaacaggcgcgtctcaccaatcaacagctggacgcgaaaattgccgcagcccaggcgagcctgaaaaccgccacgctgaccgcgcaaaacgataaagttacttataaccgttatcagcgtttaagcgccatgcagaatgtgtcgcaacaggatctggataaagtgcgtaccgcctggcagagcagcgaacagtcagtgaatgcgctgcgggcgaacatcagcgagctgatgattgagcgcggcgaaaaggacgacagccgcaacgtgacgctgcaaaaataccgcaacgcgctgacccaggcagagctggatctggcgtggaccaaagtgcgcgccgaagcggacggcatggtgagtaacctgcaattaagccccggctggaacgccgctgccggatccgcagcgctggcgctggtcagcgagcagacggatatcatcgccgatttccgggaaaagagcctgcgccatacgcatcccggatctgacgcggcggtggtgtttgacgcgctgccgggccaggtgtttcatgcgcacgttaccagccgcgacgcgggggtactggcggggcaggaagcggtgaatggcgagctgtctgcgccggagtcctctaaccgctgggtgcgcgatgcccagcgtatgcgcattcacgtcgcgctggatgagccgctggatcagcggctgccgaccggcgcgcgcgccaccgtgcagctgtataacagcgaaggtccgttcgcccgcttcttctccgggctgcaaatccatttagtcagcctgttgcattatgtctattaacaacacgctgacccgcgttttcacgccgcacgacaagatcgtctttactgccaacgatctgcgtcagacgatgcgtattgcggtggcgggggtgatcgcgctcagcatctcaagcttttacaacacccagtacggcgtctttttcgtggtttatccgctgatgctgatggcgctggtgccgatgtttaaccggcacgtggccaagcagtttattttgagtgcggcgatcaactgcatcgaaatggtactgatcatcggctatctgtcgcagtggccggtgatcatgacgctggtggtgtttggcctgtacgtgatccgttttcgctttatgagccaggggccgctgttcctgttcggctccatgggcgtggtttgccagagcgtaatgctcaattttatgagctaccccaccaacgactggcatgtgctgctgttctccaacatggaggccagcgtgatggcggtatgcctgagcgcggtgctgcactacctgatcccggatgtcgaaccgcgcacgcgcccgccgctgatcgagaaaaacgccgcccgcgtgcggcacgaatcgctgttgtccggcacggtggcgacgatgatttttatcgtcttccaggtctgtaatctgagcgattcgctgtcggcgctgatggcggggattttgtcactcttcccgatgcattatcgcggcgcggtgttaagttcgctgtggcgtatcgtcggcgtggtgctgggctgtatgtatgtgatggtggtgcagctggtgctctacgatcacagcagccatatgttattgatgatgccgctgattggcctcggcatggccttcggcgcgcgcctgcacaccatggaaaaagtcggagcgggcgtgggctttgccagcgtcaccaccctcggcattatgttcggacagaacatgcatccgaatcaggatctggtgttcagcgacgtgtaccgcattgcgtcggtaaccgtctcactgctggttactctgaccatggtttttctggtgcacctgatcctcaatcgctttgaggcgacccgctacgtaattgatccgccgcaggccggagtgtgacaaggcgcgttacaggctgaaagagaagcgtgaaaacagcgccggaagctgtgacagcaggaataaaatcagcccgatagtgccgccgaccagcgtgccgttgacgcggataaactgcaagtccttgccgatgttcagttcgatctgctgcgacatatctttcgcgtcccagctttttaccgtgtcgctgatatgcccggtgaggaagcgggcgaactccggcgcaacgctgcgcgcggcctgctccaggtgctgattgagcgacgcgcgcagggcgctgtcggcgacaagggtttcgccaaaccacagcccggcttcggtgatgcgctgtttaacgcgggagtcgtcactttgcatatccgctttcagccagccgcgcagatcgccccacagttcccccagatagcggttaaaggcctcatcctctttcagataggttttggtgctttcggcttttgccgccatttccggatccgttttcagccgctcgatcagccgtaccgtggcacgatcaaaggcaaggcggatctggtgcgcctgatcggcgctgatgtctgccagcagggaattcaccgcgctggtgaccagttcggcgctgtgctcgccgagccattccgtcggtagcagccgcgctttgttcggatgttcggttttgagccagcgcacgatctgcgcggcgataaaggtacgggtgctctcgcggcctaacagcgtgaccagctgcgcaataagcgcgtccagcagcgcctgatgacgattgtttttggtcaggctttccagtaccagcgcggaggtgccgctgagatccaccttatcgatggccttatgtactgcgcgtttgagcaactgctgaatgcgcgagtcatcagtcaaatcgagaaagccgctcatcacctgcaaaaggttctgcccaatgcgcgcggcattttccggtttactgaaccagttaccgatgatcagggccggttcgtgacgccggatcagatcaataagcgactgggtatcgagaaatttttcctgcacgaaaaccccgagattttcgccgatgcggtctttattgcgcgggatgatcgccgtatggcgggaaatgaacggtagcgggacgcggcgaaacagcgccaccaccgcgaaccagtccgccagcgcgccaaccatcgccgcttcggcaaccgcctttacgccgctgacccagatcgagggcggcagaaacagggtcgtcacaaaagtcgccgctgcaatcagcagtagcgacagcgccagacgcttggcgcgtttaagttcagcgagtttatccatggtttaagaatagatctcctgaccgtatccaacagattaaattctctcacatttctgtcgaaataaaatcgtgctgaaaaaacgcggcattacaggtatcgtctttttatgaaacggagagtttaaaagatgaaaaaaagagtcctgctaatcgccagcgtcatcctgttgtgctgggtgatgatttttccgatgtcgctactgttttcacgctacagcatcggcgagccgaccatcagtttttataatatttttaatgtgctggtcagtgcgctggcttttgccgggctggtcaccacactggtattgcagattgaacaaacacgccgcagcaatatcgatagcatcgaacgaagcgtatttgaactgttcaatacctttacctcggacagttttcaggccgtcaaaaacgacgcgtttttatgcctgttaattgccgtaagacataagccttacggcatgtttttaacgagccgactattcccggtcgggcgtttgccttttcctgaaaaagcacggcagatttacacgcaattccggccagagctggctacagcgtctgataaagaactggcggatgtggatcgtgctgcccgccttcacctcgataacatacttaactttttttcaatgctggcgcagcgtcaggccgcgcactcggtgatcaaacaggttaacttcgcctatgactggtggcggcctacgttatggatcattgcccagttacagtatgaaatctggacgggatccgaaaccgtgcgtcagtcctgccggacgccgttactccgggaaaccctgaaaacacttgatgatatttacggatatgagccgctggtgccgggaccagcagtttatgcttatctgcgaagccatccgtggctgcgtgaagagaagctcgatagcgcctactgactcagggctgccagcggcgaagcgcagtgtgctgttcatagggcatcggcgaggggcgggtgatcatttcgataatgccgccccagggcgtacggccatagcaaaaggcgttgccgtcgccgcgctcggggggaaagctcagcgctttcggcccggtgaacattgcgccccccgcctgttcaaagcttttaatggccgcctcgatgtcatccacatacacggcaaaatgttgcagaccatagtcattcgccctgggcggctcccgttgatcgtcgccgtgcatttcaaacagctcaatgccgggaccgtgatgcagtttcagcatgcgcaccgctttcacctgcgtgccgggcgttaaacgcagcgttttctgctgcgcctcctgatcgacctcatcccctggcgcgacggaggtgtatatcacttctgcccccagcgcggcgcagaaaaaggctgtcgcctgttctatatccgggacggtgatcccgatgtgatccattccccgaaccgctgattgcgacatgatgcctcctctgttttctgccttttttcaaagtaataaaggtagaaggtaagccacgtaaaacgccatacagaaatgaaaaatcataggtttatacgaaactttacgcttaatcgcagtcgttacgtctaccattaataacccagatagcattttttactgcccatcaggaggtatttgatatggcgtaccagacaatgaatccttttaccaacgagcttgtaaaagagtatccgccccacagcgatgccgacgtcgaaagcgcgctgcaaaaagccgatgcgctttaccactccgactgggcgaaaggggatattgatcagcggctgccgatcctgcaccgcctggccgatctgatggaagagcagcaggaagaactggcaaaaattgccacccaggacatgggtaagctgattgaacagagccgtggcgaagtggcgctgtgcgcgaaaatcgcccgctattacgcggataacgccaaagccttccttgcgccggtgaaatatgactccgatctgggcgacgcctgggttgagcatcacccgattggcgtactgctggcggtggagccgtggaacttcccttattatcagctgatgcgtgtgctggccccaaacctagccgccggtaacccggtgctggtaaaacatgcgagcattgtgccgcactgtgccgaagcctttgcgcatctggtgcgtgaagcgggcgcgccggaaggggcgtacaccaacctgtttatttcatccgatcaggtatcaaacattatcgccgatgaccgtgtgcagggcgtggcgctgaccggttcagaaaaagccggtggcatcgtcgctgcgcaggcggcgaagaaactgaaaaaatcgacgctggagctgggcggtaacgacgtgttcgtggtgctcgacgacgccgatatggaaaaagcggtgaaagtgggtgtcatggcgcggttgcagaacgccgggcaggtctgtaccgcggcgaaacgctttatcatccatgaggcggtggcggataagttccttgaaaaatacaccgaggcgttccgtcaggtgaagatgggcgatccgctggatgaaagcactacccttggcccgctatcctcgaaagatgctgtcgaaaccctgaccaaacaggtggccgaggcggtgaaaaatggcgcgacgctgcactatggcggtaagccagtcgaccacaaaggtaacttctttgaaccgaccattctcaccaacattacccgtgataacccggcgtactttgaagagttcttcggcccggtggcgcagatctatgtggtgaaaaatgatgatgaagcggtgaagctggcgaacgattcccactacggtctgggcggcgcgatcttcagccagaacatcgagcgggccaaaggcctcgcctcgcgtatcgaaaccgggatggtttacatcaactcgctgaccgatactgcgccggagttgccgttcggcggcgtcaagcgctccggctttggccgcgagctgtcggatctggggatcaaggaatttgtgaaccagaagctggtggtggtgagtaagtaattactgattagcatcatggccctcccgcaggggagggccaacctccttccgctttaagcctcttattccccagattcaaacgtcatattagcgatgtgctaaaactgtgaaataataaccagcatcaagaatgatacgggaaagagcgatgtcgactgaactgctggggctgacctgggacgcaagcgtgatcccggaggttaaaaacgtgggtacccgcgtggcgttatttacctttaaaacccatatggcaggttttgtgtgggacgcggcacagctggaaaataacccctatacctatgttgaagttaaaaccctgctggatggcgttaccgtcggcggccataaagttagtgataccgagcaggtgttaaaccttgctgacagcagcaaaaagctgattgagctggtgcagaccgggcggtttgatctcgataaaaaaaccttcacgctgctacacagtattattgcccgtaacgaagcgctggaatggggcgttttccggggtgaaggggatgaggtgcattatcaggcccgcgttcacctgggggaactgggtacgcattttccgcccgcaacggaagccggcgctccggaacttaaccggatattttcagagggtgcccgccagatcaaaaccctgccgccttttgaaggcgcgctggccatgttcctttttggcgcttattttcaatttttctttgacggtaataaacgcaccagtcgtcatatgatgaatggctggctgatgctgcacggcttcaaccctatcagcatcccggctgcccgtgcgctggaatttaacgcccgaatggtgcgtttttatcacagtaaagatgccaccgaaatgatgaagtttctggtggagtgttatcaggattaacgttatgccggatggcggctgcgccttatccggcctggattatttcttcagccccataaacgccgctctgatctcctcttccggcaactgtaccccgataaacaccagctggctgtgcggtggctcgtcgccccacggacggtcccagtcggcgctgtacaggcgctgcacgccctggaacagcaggcgattcggttcgccgtcgatccacagcatccctttgtagcgcagcagcttttccgcgaagctcagcagcagattttccatcacccgcgacacctcgctgatatccaccgggtaatccatctccaccacaatagaggctatatcgttctgcttatcgctcataaaatggaagcgcggctttgccggtacgatggtttcttccagcataaagccatgagtgttaaacagcagcgccagatcggtttcaccgtggatcacggtgtagacaggcgcgcgggcattgatgcgcgccagccgttcgcgcagcggttcggcctcgccagcaatatcggttttggtgagcagaatgcggtcggcatagcccacctgcgactgggccagggtgaactggttcatctgctcatcggcatgcaccgcgtccaccagcgcgatcacgccgtccagcaggtagcgctggcagataatttcatgattgaagaaggtctgaataatcggaccgggatcggccatgccggtgcattcgatcaccagacggtcaaattcgatgtcgcctttgtcgaggctgtcgagcagatccagcagcgcgtcctgtaattcattagaacgactacagcagatacagccgttggtcagggttttgatctgcgtggcgcgatcgccgatcagctgagtatcgacggagacttccccgaactcattttcaatgacggcaattttataaccgtgctgttcattgaggatatggcgcagcagggtggtttttcctgcgccaagaaaaccggtgagaagggtgacggcaatcggggtcatgaggtttccttcttaacagcagctgcttccgccgctgccatagcgtgcttcctgacgttcacggaagaactcgttataggtcatacagggcttgtccgggtgattggttttcatgtgttcgacgtagttgtcgtaatcaggaataccaatcagcatacgcgcggcctggccgagatacttttttgcttcgcctaagttaccaaacattttccatcccgataagaaaaagcccggcggcgctacgcatgccggacctgaagtattttgtagggcgggtcagcgcagcgccacccgccaggctacttagtgatgcgaggaggttttcacgccgccttccggcactggcacgtacggcgtttctttatccgtgcgtaccgtgctgttacgggctttcatccaggttttgaagccgtagaaaatgatgctgtacaccaccaccaggaacagaatgctcaggcctgcgttggtgtagttgttcaccacgatgtggttcatgttcgccacttcctgcgcggtcagctcgccgccggcggcaatacgcgctttgtactggctggccatgtagaagaagccttccatctgcggattgtcgctgaacagcttcaggccgagcgcccaggtggtgcagatcagcagccacaccgccggaaccatcgtcacccagatgtatttagtgcgctgcattttcaccaataccaccgtacccagcaccagcgccacggcagccagcatctggttggagataccgaacagcggccacaggctcttcacgccgcccaatggatcgaccacgccctgatacagcaggtagccccacagtcccacgcagcccgccgtgccgataataccggccaccagtgaatcggttttcttcaggaaaggcacgaagttacccagaagatcctgcaacataaagcggccggaacgtgtacccgcatccagcgcggtcagaatgaacagcgcctcaaacagaatgccgaagtggtaccagaagcccatatcagcccacggcaggatcttgtggaacacatgcgcgatccccaccgccagcgtcggcgcgccaccggcacggttgagcacggatggctcgccgatgtctttcgcggtttgcaggatctgctcaggggaaatcacaaagccccaggagctgacggtggccgccgcatgcgcggtgacgtctttcagctgcgccatgatcagcgggccgttttcaccacccagctcatgcaggtttggcatcacgatgcccagaccggcaggcggggtgttcatggcaaagtacaggcccggctcgataatggacgccgccaccagcgccatgatggcgacgaaggattccatcagcattgcgccataaccgataaagcgcgcgtcggtttcacaggccagcagcttcggcgtggtgccggaggcgatcagtgcatggaagccggataccgcgccacaggcgatggtgataaacaggaacgggaagagcgcgcctttccacagcggaccggtaccgtcgatgtactgggtcatggcaggcattttcagttccggattaaggatcacgataccgatagccagaccgacgatgacgccgattttcaggaaggtcgccagatagtcacgcggcgcgaggatcagccataccggcagcagcgccgagataaaggcgtagccaatcagcgtaaaggtgatggtggtgtctttaaaggtcagcgccgggccccagtacggatcgtgcgcaatcacaccgccgaaataaatcgacgccaccaacagcaggataccgatcaccgacacttcacccacgcgacccggacgcaggaagcgcatgtaaatgcccataaagagcgcgataggcaccgttgagcagacggtaaagacgccccacggcgattccgccagcgctttcaccacgatcagcgccagcacggcgaggatgatgatcatgatcaggaagcagccgaacagcgcaatggtgccgggtaccgggcccatttcttctttgatcatctcgcccagagacgcgccgttacggcgggaggagatgaacagcaccataaagtcctgtaccgcaccggccagcaccacgcccgccagcagccacagggtgccgggcagatagcccatttgcgcggcgagcaccgggccgaccagcgggcctgccccggcgatggcggcaaagtggtgcccgaacagcacgttacggttggtcggcacatagttcaggccgtcgttgttaatgaccgcgggcgtggcgcgcgtcgggtcaagtttcatcaccttctgggcgatgtagaggctgtagtagcggtacgccacgaggtaaaccgaaacagaagcgacgacgatccacagggcgcttacgctttcaccccgtcgtaaggcgacgaccgccagacagaatgcaccgaggatccccagtatcgcccagggtaagtgcttaagtagctttttattatccatatcagacctggctttaagaccgaaaaggtcaatgtgtaagtagtgagttgaagagacagcttgccgggcagatcatgacaaagagtgcgcaaaaaacgggcgtaatctggctaagcggtagttaatggggggtgagtggtcggcgtgaggagtaagcggttaattgccgctgtgagcgccggaaaatgtgtgattgcgatcacgtgaaaatttacgtttcgtagaagcgtatggcagcagacgcttctacggaagcactttaaataacgataaagcagtatggcgtgttatcgataggttgcagcagtacgtgtctgtcacgtgattttgtctggtaatacttatcgttaaggtaacgatcaatgagttggtcgagccgttcgcgatcaatcaacgtagtaatgcccaatgtccagaagctgcgcagatcgatttcagaacgtttaatacgcgcgctcttttccaaatcccgaatcatatttttcacacaacttgtgggatcacggttctgttttacttccagcgcgatataagtatccagtgcccagcctttttttcgcagcagaaaatcggtgcgcagactattgcgtaccggatttttacgtaaatcacaccccaacgtctgttcacgccaccactcatgcccggtagaaaccagcaggttagcaaattcaatctgcatccagatttcccagccagagatatcatactggtcgataatgttgagcttctggcgaatatcttcccgttcaaaaaaaagatgtagcaaggtcgtcaaatggtcgtaatcgcgatcaatcatggggttctcccgaaaaaatcacattatatgcatggtttttaggatgaaaaaccataatgtgataattgttgttacatcgtaacttaatgaaaattatcgggataacgtgctgaattagacgactgcatggaagggggctacacactcatcgactaccgcttatgcgatttaccgtaaagtttttcctatccaggccgacaaagtgttattcgtccaaaggaatgaaaaacatgttaaaccgtatcaaaattgtgaccagtttactgctggtactgtgtttatttggccttttacaattaacctccggtggtctcttctttaacgccctcaagcatgacaaagaaaacttcaccgttctgcaaaccattcgcgctcagcagtccacgctgaacggtagctgggtggcgctgttgcagacccgtaacacgctcaaccgtgccgggatccgctacatgatggatcagaataacatcggcagcggcgcgaccgtggcggaactgatgcagattgcgaccgcttctctgaagcaggcggaagtgcgctggaacgagtatcaggcgctgccgcgcgatcctcgccagagcgaagccgcagccgccgaagtgaagcgtaactacgacatctatcacggtgcgctggccgagctgatccagttactgggcgcaggcaaaatcaccgagttcttcgatcagccaacccagggttatcaggatggctttgagaagcagtatgtgcagtatctggagcagaacgaccatctgtatgacgtggcggtcgccgataacgacagctcctacagcatggcggtgtggatcattatcagcgtgctgaccgtggtgctggcggtgattattgccgtgtggttcggcattaaaaacgtgctgattgctccgctgcaacgtctggtggaaagcatccgtcacattgcgggcggcgatctggaacaggatatcaacgtacacggcactaacgagatggggcagctggcagacagcctgcgccacatgcagagcgagctggtacgtaccgtgggcgacgtgcgcagcggcgcggacgcgatttacagcggcgccagcgaaatctccgccggtaataacgatctctcctcccgtactgaacagcaggccgcttccctggaagagactgccgccagcatggaagagctgaccgctaccgtgaagcagaacgccgaaaacgcccgtcaggcgagccatctggcgctcagcgcgtcagaaaccgcgcagaagggcggcaaggtggtggataacgtggtgcagaccatgcgcgacatcgccggcagttcgcagaaaattgctgacattatcagcgtgatcgacggcattgccttccagaccaacatcctggcgctgaacgccgcggtggaagcggcgcgtgccggtgaacagggccgtggttttgcggtggtggccggtgaagtgcgtaacctcgcccagcgtagtgcgcaggcggcgcgtgaaattaagagcctgatcgaagactctgtgggtcgcgttgaaatcggctccacgctggtggaaagcgccggtgaaaccatggatgagatcgtcagcgcggtaacccgtgtgaccgacattatgggcgaaatcgcctctgcctctgatgagcagagccgcggtatcgaccaggtaggtctggcggtggcggaaatggatcgtgtgacgcagcagaacgcctcgctggtggaagaatccgccgctgccgctgctgccctggaagagcaggcgagccgtctgacgcaggccgttgcggtgttccgcacccgtcgcgtcgcacgcccggcttcagcaggtatcaccccggtgcagaccatggcgccgacggtgttgacgcgtaaagtcgcaacgacagatgagaactgggaaacgttttaaactttaaatgcccggtggcgctgcgcttaccgggcctacaggattgcctctgtaggcccggcaagcctgcgccgccgggcattaacgttcaaatggtttgctgattgtaggcccggcaagcttcgcgccgccgggcattaacgttcagatggtttgctgattgtaggcccggtaagcttcgcgccgccgggcacatccaaatttacccgccgactttcaccactttaatttccaccatcccgatacccagctgacgcggtgaatgaccgagaatattgccttcgttggtcgactgcggatccggcgggacgatctccagcgtattgctgtgcgccggattactgaagcgcagcgtggtggtggaaagatcgtgaccgagggtcagcgtctgttcgctgttaccgacgcgcaccgggatagggcgatcggcgttcgggccaaaggctttggcggtgatcaccagatcaaactccgcgggcaacggcgccttgtattcgattttcaccgccttaccaagctgagcgttcgaccagcgtccccaggattccggacgcgaaataccgctgaactgcttcacttcctccggcgcgccggcgacgttaaacacaaagctgtcggctttgtagcgaatatcgttatccaccacttttaatttatcgacgttcgccttatagcgcagggtgtcgatcatggtctctttgaaggccgttttgccttgccactgtgcgcggtcaacgcgctgtacgcgctgctcgccgcccagctgtccctgggagacgcaccagtcagtggacagcgccagctgcggcgcccacagctgcgccatcttgtagcactgatcgacccacacgaaattatcccgcggcgcgaaatccgccagctggaagcgcagcggggcggagtattcgctctccggcagcggctcgacgcgctgatcggaaacacgcaacagcagcggcagacggaaatggctgccggaaaaggcgatcatctttttgtcggtatcgacggtgaaatccttcatctctttcgggaagttccacagccggatgatgtccggcttccaggacagcaccttctctttcatattcaggaaggattccgacagcgactggccggaaaggctgctgcgcccgaggccgataaagttatcgccgccgagaatatccagcacagtcgcgccgttatccatggtgttgcgcttgaggccggacacgtcctgctgcggtttatcgccacgcagcacaaagaacaggttgttgcgatcctgcttgctgaggtatttccaggcggtgttattcatcgccagatgatcggacgagaccacaatcaccgtgtccttgtaccagggcgaggcctggattttctggatcagcgccgcaatatgctgctggctacaggtgaccgcgctgaacgactggttgagtttgccgtccatctcatagcgtttacgatcgcaggtccgcgagataaaaccgtcaggatgatgggtgtccaccgtcagggtgaacagcgaaaaacgtttgccgcttttggacagttcttcgtactttttccacacctcatccagcacggtgtcgtcgtaaaaaccccagtcattacggtaagcaggatcggcaacctggcttttcaactcttccgcacccaccagatgatcgaaaccgtgggatttcaggaacacgtctttaccggcgaaacgcagattcgcgccctgcacgaaatggttttcatagccggagtttttcaggatatcccccagacacaaattctgcgggaagaagctcgacatggacgcagaggcgttgccttcaaaaggcgcgaacagcggaatgccgcactgggaggccaccataccggcaatggtgtaatcggtgccgggcagctgcgcggtatgggtaaaatcgatgctgttatttttgattgcccccagctccggcgtcagatccgggaaggcggcgttatcgaaataagtgcgctcaagactctcgccgtagatatagacgaggttgagtttgggatccggaatgcttttggcgggcactttataccaggtgtcgaagtccggcgagctttcccgcgactgggatttaaccagctcggtgatctgatgaaacgccgggctggcatccaccgagccgagcgccagcatcagcgccagcaggctgtagccaaaatgaaagggcatatggcggcgacggcgcaaaatccagccgagggcgctgaacaccgcaatcagcgcgaggatcaggcccgcgccgggcaatatgtacttactgacgcccgcgccggtcaggctgttggtcagcgtgtagagcaccgcatcgttgataccgtcaccggtaaagtaatcgctggcgtagagggtgatattaagaaccacaaaaaggccgagcacaatcagcgtggcggtaaaccaccatgtattgcggcctgctttccaggcgtaaatcaccacggaagcaagaaaaagggcaagggaaagtaattccgacacagcctgtcctcatcagtcgccagtcgcgcggctggccattgctgttatttttgagcgatacaatgtaaatgggatgtcatactgctgcaattctagtgtcattaaatcgtgcagtgattcagatttggtttagatgtgtgactatttgaagagcgtcgcatctttaaatgaggcgggaataatggcgggcaaagatggaaagcggcaggcgacgtcgcgtctgtcatgaacgcgacgtttacgcccctcaggacaggaagcctatcccctgtttcagtacgatatcgcaggctttggttttgactttctccgccagcggggagttgccgatattactcaggctgagttgttcaccctctttggtgttaagcagtccctggaggccatcaagatagttggtatcctgctgctgcgcggcgggcgtactcaggcccagtttttccatcacctgatttttcacgttttccgcattggtgaccgaggccagcttgtttttggcgcaatactgcaaaatgcctgcggcattgttcatgttgtcggcgcttaacgcctggttgccgccgttaagtaagccgcccagtgacgagagcgacaggccgccctgctgtgagtcattgttctggctgagctgcgtggcagcgctggagagggattcctgccaggaggcggcgttggcggcggtggagagaagggcgctgccgacaagggcgcagcaaagcatacgttgggctaatttcatctggcgtactcttgggtaatgccctgacgggcaggatcggcccattattacagggccgacgcgcattacgggttcagattgctctcaatactcttttccggtgacgcggctgcggtagctttcccagttgaatatcacccacaggctgttgcccagacgcatcctgtccatcacgcgctcaccgagcagtttggtcatttcgtccatattgctgttggtcagcatcccggtcgggcgtttggaggaggagcgacgatcgacgatctgattgatgatcactttttcgtagcgcgattcggactgcatgccgatctcgtcgatcaccagcagatcgacattgctcagatcgttgagcaactgctcctcgctgatctggcgattattgaaggtgtctttcatcgccgacataatatccgccacggtaataatgagcaccgatttgccgcgcagcagcagttcgttgcagatagccgccgcgaggtgatttttaccggtgccaggcttgccggaaaagataaagctggcgatgttgccgtcgaaggcttccacgtactgacgcgctttggcaagggcgttcatctggccttcgttctcgactttatagttatcgaacgagcagttctggtgtaaaggacggatgccggagcggttaaaggtgcgctgcattttcatggcgcggttttcacgcgcaagggcagcggcgcggatctcaccttgctctttttgccacgccagcagctcttcgcccgttttaaacgcgggtttaacgtgctctggcatcatcttttgcagacgtttcatcagttcgccgacgtttttcatcatcatcctctgaaaccgggtggaatttgattatcaggctcgctcaccgtgttcacatcacgcctgagcgatgcgccctggctggcgcggctcatctgaacgctgcgcgccagcttttgctgccactggatatggtggaagactttgccttccgcctgccagtaggccacgaatgacgccagttcttccggcgtaaccggctgcgtcaggccgataccccacagcgctgcctgacgctgaaaatccgcgtcgggctgccaggcgggatacatggcaaatttccctatcggcacgctcaccggcgcggccgcaggttcttcataaaactgtgcgtccagcgccacatcgctggccgggcgttccagacgggcttccagttccagcaactgcgccagccgcgcaggggtgagcgcgtaaaaagccggtgcattattggcaaacacggccaccgtgccgtgcggcgcttgcgccagaacggtggcgtgctggcgcgtaaaatcatcgatgccgatgacgttcgtggacaggattctggaggacattgtgctatctcaaactgactggtacagacattgcgaagggatccgcaactgatatgtgcacatagtagcacagagcgctgcccggaaagcagtgcagaaaagaaagccgggtttccccggccttaagtgttgactaatcaacaggataaaggaggcggctgcgcaagcgggcagccgtcttgtcctcccgaaaagccccctggtgagggtaataaatcaggaaataatgttcagcgtaacgtcgatgttgccgcgcgttgcgttggagtaagggcaaacgatgtgtgctgcatctaccagttttttcgcttcgctggcatccatacccggcaggtggatgttcagtttggcttcgataccaaaaccggtcggcagcggcccgatacccacttcgccttcaatgaacgcgtctttaggcatggtgattttgtcgcgtgcgctgacaaatttcatcgcgccgaggaaacaggcagagtagcccgctgcaaacagctgttccgggttagtggcatcaccgcctgcgccgcccatctctttcggcacgcccagtttcacatcaagtacgccgtcagaagaggttgcgcggccgtcacggccaccggtagctttggcaacagcggtatagatcactttttcgagagacataatgtgttccttttgtatgctataaaatagcgtgctatttatctgcgagcataatcactctgaatgagtcattatgcgcggtgtaagttttcgcgtaacttttccagctccagcttgagcgacgtcagcgtggcggtatcgcaggcggcggcgcagcctacctgttcaggaatatcccgcgcctgttcctgcaacgcccggccgctgtcgctcagcgtgaccaccacctgccgctcatcctggcgggagcgctgacggctaatcagcccggcgctctccagacgcttaagcagcggcgtcagcgtggcggaatccagaaacaggcgctcgcctatctccgataccgtaacatcatcccgttcccataacaccagcatcaccagatactgcgggtaggtcagctgcaagggcgccagcagttgccggtacactttgttgagcgccagattcgcagaatagagcgcaaaacagagctggttatcaagttccagtacgcggctggatggagcggtcttcgtcttcatgagatgaatatagatagtgcacgatttaattgcaagttatttgtttgcgacatgtcaggggcacagataacgcagcaccacctgcaccgccatcgcgcgataatgcgcttcctgggcggcgctgtcggccccgtcttcaaacagcagggtgaaggtataactgttggccacgaagtgaaaactgaagctgctcatcaggcggtggacgtcgcgtgcagtgaccgttttattaaagagctgtttgcgctgcccgcgctgcaaaatatcttccagcagatccagcgcgctgcggtttaccgtgcgcagcaccgcagactcttgcatgaagcgcccccgctgcatgttttccatgcagatgatgcgaataaaatccggatgggcggcatgataatcaaaggtgctttcaacaagctgtaccatcgcttccaccggcggcataccggcaaggttcagccgtttttcactggcgcgaatttccgtatagacgtgttcaagcacgcgtaagtacaggttttctttggttttgaagtgatagaccaccatgcgtttggtggtgcccgctttttccgcgatctgctccatgcgcgcgccgtttagcccgtattccgcaaacagcgtaatggcgctgtgaaagattttatctttcagactggcttcgtcacttttctctgagggattactgccatggtgctccacgctcactccttataggccaaaacgcaaagggggattatcaccacggcagcggcagaaaacaaatttcaaacgcgcgggcgcttgcggtagatccacagcccgggcaccgacaggccaatcgacagggcggctacgatggaagtggccttgaggaaattggtcagcagcaggatcatcagatcctcgctgtagcccagatggccaatttttaccgctgagatcatcgcggtataggccgaaatgcccggaaacatcgggatcaccgccgccacggtaaagactttcgggtgcgccagataccagcgcgaccagcggatgccaatggccccaaccaacatcgacgccataaaggtggaccattcgatattgaagcccgcggtgaccatggtcatgcgcgacccgtgaccaatcgcccccagtagcgcgcaccagggcagggcgcggtgcggaacgttgaacaccatggcaaaaccgacggcgggaatggccgacagcgccatgtcctgcatcagcgccagcagaaaatcgattatgcccatccgcgcagcccccaaactgtcattgccatcaccacgcccacgcaggtggcgagggtcagcaggctggcgatcgcccagcgcgccagtccggtattaatatgccctttgaacatatccgccacggcgttgatcagcggaaagcccggcaccagcaacaacacgctggcggccattgataccgttgaggtaagcgcgaaagtgggcagcatcagcaataaacctgcgaccgtggtcgccacaaaagcggtaatgcagaaattgatctgcggatgcatatgccgctgcgccagcgtcaggcggacgtacatggcgatgctgctggcgaagaacgtcaccaccgcgccgtcccatccgcctttattaagtctgcaaaagcaggcgcaggagaggccgaccatcagcaccatcagccagcgcggataacgcagcggcttgacgtgattgaagcgcttttcaacgtcccgataatcgagcagtttatgctcggccatgatgacaatatgctgtacctcggtcaccacatgcatgttgatcccgcgatcgctgttcttgcgcgtcgaggtgagacattcaccgtctttaattgtcgtcagcacgatagcattggctgaaatcgaactttctacgctgtccatccccagcgccagcccaagccgcgtggataattcttctaccagcgcgctttcggcaccgtgctgtaatagaaaaagaccgcactgaatacataatcgcgtgatggtccgctgtgacgcctgctctgcttgcatgtcgtgccctggtagtcaacgccaaaacgcctgaaggccaggcggaaaatctatttttagcacgaagcgtccatggcccggtcagggggcagatcaatatttattcattatctttgagaattcttatcttttaccggatgcagtgcggacggggcctgacggctactcctgaccgtttttatattcactaaatgaataatttaatttttacttaattttttttgtattttttaaccatcaccctggttatttatttttcacaatttatgcgatattagcgcggtgagagcaggatgtaataatctcatggttaatctctccagaaggaacagacgtgccaggtggcacgctacggttagtatccagggaaaagtgtcagaaaagttaaggatgaaatcagcgcttattaaaagcgtatgttttctcctgagtttctgtacttaaaaaaggagacggataaattatggttacaggaagttgtaagttcggaatcgttattagtaaagcacctatcatacaaaatggccttggcaatattattgcccaccattttcccgaatatgaactctcgtattgccgcgcattagaagagcttacgttactgcaattgcggcgcgcagatttagtggttgccgatttgtcaggggacattcgtcatccaaaaaatctctgcgaacagtactacaagttattgactcagtatcttgatattcactggatttttattgtcccgcgtccgttatacccgctggcggtagaaatgctgctgcgcccggaaagtaccttactgtctcaggttgatcccattgaggtcgtggtgaacgccattcgcgcaggcagcatcagcgccgaacggatcagccaaagcctgctgtccccggagccaggtgaatttgacgaagaagaggaaaaatcagcactgctgacgctgtctgaacgccgggtattacggcttatcggaaaaggttggggcattaatcaggtcgccatgttgctcaagaagagtaataagaccgtgagtgcgcaaaagaatagcgccatgcgccgcctttcactgcgcagcaatgctgaaatgtacgcatggattaacagtgcacagggaatgagagagctgaatctggcttcagcctacggagagcaaacggaatggaaaagaaatgtgcaaagcggcatgttgctgtcatcgaaagttgtgtaatgagtgagatcgggctgtcacatcttttcagcacctcagccttgagtatgtataagctccatttttttaaagattacccatcgtttgaagcggccgcgctgaagatgccttttttttctgtcatattttcactttccggactgcgggcagagcgtattgactgcctgaagagtctgctaaaacttgcaaaggggtatccgtccgctcagcgaattgtgctggcgcaggacgataccgaagtgcgtctgatgagtttgctttccccttccagtctgcatggcatcatcagcaaaacgctggcgattgggctgttacaggagcagctttcgatactgctcaacaatacgcatcggcttaatcaaaacgtgataaacgactggtacgtcagcaaaaataatgggctgagtccgacggagcgcgcgatcctgcactacatgacctatgggtattcgatgccggagatcgcgcactatttgtcgcgtaatattaaaaccgtgcgcgcgcacaagtttaacgccatgaccaagctgggcgtgcattcggatgcgggactgctggacgcggcggatattctgatgcacatctcgattgaccgaaaaccgcctgcggtccatatggttgcgtgaattttgctatcaatctgcacagctgcgccagacgagactctggcgcagtcttttattcacagacatccacccaggtggcagacgtaagttgcgccatgcgcgacggtgaaatacgcacggcgctgtgggtagcgcctgcggcaggcagcacttcctgatactgcttaagggatacatcgcagtagacagccagcgggttctccagcccgaaagggcagacgccgccaaccggatgcccggtggtgagcaccacttcatcgctgctcagcatgcgcgctttcgcgccaaaggtggatttcagctttttgttatccagcctggcgtcgcctttcgccacgatcaggatcacttcatcttttactttcaacgacagcgttttggcaatttgtccgggttcaacattgtgcgccgctgcggccagtgccactgttgcagtactctgacttagttcaataatttcaatatcgggggcctggcttgcaaaaaactcccgcacagaatgcagactcattgttatctcctgggaacgactggcagtaatctggcataagccttcgtgtgctgtaaatattaattaatcacaaacggatctgccggatttctcgatcctcttcacaatcacggaaaccggttacagtaaccggttgcagtgtccgtggcggagattaatactcgttttacccttcctctgtctcagataaaaagagccgtctatgaaacgtatcctactgagctttaatgctggtcctgagcccggcatggttgtaaacccgcataatggattgccgcacagctcgctgtttaccgctgctgcgtttaacttgttcgcctgacaggagagctgctatgtctgataaccatgctgcgtttaatctgattttccgcttcgttgaaaattacgtcagcccgattgccgggcgaatttcttcccagcgtcatgtgatggcgatccgtgatggctttatttccgccatgccctttatgatcgtcggctcgtttttactggtctttgcctatccgccgttttcaccggataccacattaggctttgcccgcgcctggctggatatggccaaacagttcgaagggcagatcctgacgccctttgatatgaccatgggcatcatgtcgatctacatctgtgcggcaatcgcctataacctcggcaagcactacgtgaaatcgcatcagcttgatcccttcatgtgcgccatgctgtcgctgatggcattcctgctggtagccgccccgaaaaccaaaggcgcgatgccggtagacagtctgggaggcaccggcatctttacggcgatcctcgtcgccatctattgcgtggagatgatgcgttttctgaaggcgcataacattggtatccgcctgccggatcaggtgccgccgatgatcaaaaactcattcgacctgctgatcccggtgctggtggtggtggtaacgctgtacccgctgagcctgtttatccagtcgcaattcgatatgttgatcccgcaggccatcatgtcgctgtttaaacccctggtctcggcggcggattcactgccggctattctgctggcggtgctgattgggcatctgctgtggtttgccgggatccatggcgcggctatcgtctccggaatgctgcaaatgttctggctgactaaccttggcatgaaccagagcgcgctggcgcagggcgcgcccttgccgcatatctttatggaagctttctggaccttctttattgtgatcggcggctccggggccaccatggggctggtgctgtgctatttgcgcagccgttcagtgcacctgcgttcgataggtaaactgagcgtggtgccgagcttctttaacattaacgagccggtgatcttcggcacgcctatcgtcatgaacccggtattcttcattccgttcctgcttgcgcctatggtgaatgcggtgatcgcctgggccgccatgaaaatggatctgattggccgggtgatttccgtggtgccctggactgcgcctgcgccaatcggtgcggcatgggggctgggctgggatttccgtgcggcgatcctcgtggtagtgctggccgtggtgtccgccatcatctattacccgttctttaaagtgtatgagaagcagttgctggcgcaggaagccgaagaggcattgcgtgcagaggaagagcgtcaacaggtggcgtaaaagaggatggtttttgcaggccgggtaagcgaagcgccacccggcaaggaaatctgaaggggcgaaagccccttttttatttcagcgtgcaatcaccgcactgctgcacgtccggcagacggtagcgctggcagcaggtgcggcgcaccagtaacccatcacgcagcaccacggtgcgccataacggattatcctgaccatcagaaagctgtttctcaaagaagcagaactgacgcagcgccgcgacgcgctcctcgccgagcaggggtttcatctcgttgagataccagttgatcagataaccggtgttgctccagataagcttgccgttgatgtcgccggtcgactccagcgcctgcaccaccggcatcatcgcccggacaatcagccgctcaatacgttgctggtcggaaagacgggtggtgacgtgatccgcatgcacatccatccagaagcaggcggcacgtccggtttcatggaactcaacgtgaaaatgttccggagaaacatccggcgcggttttctgggttaacagcgccagcagcagcggcggcaccatcaggcccagataccactgcgcccataacgacagcagcggcttattttcccgcagttgcgttggctgattacggtagatgtgatcggcatagatagcctgcaacgactgaagcgttgacgactgtgaccattcggccagcgtcatggcctggtgaggataagcctcatcaagttttatcacatccaggaagtgcgcacggtgcgtggcaaacgcatcacgcagggcatcggccagcgataccgtttcaggacgaagcgggatacgccagacagcatcttcagtgatcggagcgaagcgataggccatagtgcgcaactgaaatggaatctaaatgataatgattgccaatcctaactatagataaaaccgatcgcaagatctttgtccggaaagtggagggcgatcgcgcttcaggcgacttttagctcaccgctgaacaggatattgttgcggcccaggtgcttggcttcataaagcgccttatccgcctgatccagcgccgcttcaatattggtgtccgttaacggcgcgatgccgatgctgaccgtcacgttggtcgccacgctttcattaaacatgtgcggaattttcagatcgtaaacctgctggcgaatgcgctcggcggccatgcgcgcccgctccagatcaacattacttaacaggatcataaattcttcgccgccgaaacgggcgacaatatcccgcgagcgcacggcatcgcggatagccgccgacacacggatcagcgcctggtcacccatcatatgaccatagtgatcgttgtaggctttgaaatggtcgatatcaagcagcagtacatagcgaacgccgctatccagcgccagcaggttatctattttgttttgcagaccgcgacggttgtacaggccggtaagcggatcgagcatgcttaaatcattcagcgtctctctttcttccagcaaccgacacatcaaatcaagggcaaacttatcattgcgcgactggatcacgttctgaatagcaatacctgccatcggcagggcgaaggaaaatatcatccgcaccatgttctcaccctcgctaaaccacaggcagcataaaaataccggcaacgagtgcaacgtgaatgcgatgatattattggaaaaagctatggagccgataaataacacgctaattaacgcaatcagcagataaggcgagccgggatcggcaagcagcgaaaatttaatggcgacatgccacgcccataatgcgccaaataaaactgagatcggcgacacatttaatttctttgccggaaagcgccagtgccacgccagcagcgtcacgctgatagtaaacagcagacacagcgggaccgtcagcgaccgcgcgttatagagcggaagcagaaaggaaaaaagcgccgaagctgcattgagaaacaagaacaaacgcagggataaacggtatttcttgttacaaagggaatgccatgagtgtgctgtcatctttaaacttaaagtcgttattaatctgcaatttaaaatgtaatggttgccaaaacgaaaaataacgcggggaatagttaatcgcgaaaatattataaaattgttatctgctttttctgggtgagcaatttatcaccttagtgaatgtatgtcatcaggcgatgcgtaaagttcatgcaatcctcattatacccgctgacaaatgagaaaacttatcatatgatattggttatcattatcagtgtgagaggcgaaagcatgttgcagcgggcgctgggaagtggatggggtcttttattgccgggtattattgtgtccggactggcgtatgccgatctttctcttaatgcatggcgggtattgatcgtgctggggctggtactgacgccagtgatgctttatcacaagcagttacggcacttcgtgctgttgccgtcaggcatagcgctggtcagcgggatgatgatgctgctgatgaatctcaagcggatgatgtaagcaggaaggacagcgggaagaaacagaagaaaaaaagataattggtgcgaggggggggactcgaacccccacatcctgaggacactaacacctgaagctagcgcgtctaccaattccgccaccttcgcactgttatcttattttttgatattgcctcgttggtgcgaggggggggactcgaacccccacatcctgaggacactaacacctgaagctagcgcgtctaccaattccgccaccttcgcccagtgcgagcaatatcatgtgatttatggtgcgaggggggggactcgaacccccacatcctaaggacactaacacctgaagctagcgcgtctaccaattccgccaccttcgcataccatcgatactcttgaagtatcgtaaccacggaggcgcattctagatgttttaggattttcgtcaacagttaattgcgtgccgtttcttcatttgctgcaaaaaacggcactttggcaattagcgttttgcctggcgggtcatcaccgtgcggtaaactttaaaacgaccggtttgcgcgatcacttcgtggaagccaaaggtttcgtccagcgcctgcggataaggcaggaaggcgttggcgacaatacgcagctcgccgccgctgttcagatgacgcaccgcgccgcggatcagggtctgcgcggcttcaaggctggtctgcaaaccatcatggaacggcgggttagagatgatcatgtcataacgcccggtcacttccgagaagacgttactggcgaacacctcgccttcaatagcgtttgccgccagtgtcgcgcggctggcttccaccgcagcagcgcttacatcacacagactcagacgcacttttggcgaatggctggccagcgccacggataacacgcctgcgccacagcccacgtccagcactttacctttggtgtgcggcgtcagggtggagagcaacagtttactgccgacatccagaccgtcgcggctgaacacgcccggtaaggtcttgatggtcaacgcgtccagcgggtattcatcccagaagctttcggcatcgaaagcgggctgtttttccaggcgaccatgatacaggccacagcgacgggcgctgtcgactttggtcagcgggcagtatgcttccagcatttgctcggcgctacgcacgccgctgcggttttcgccaatcacgaaaatatcggtgcccaccggcagcagcgacaaaatgttcatcagctggaactgggcttccggcttgtttttcggccagtagtagatcagggtatcgctgtccgccacgtcagaggcgtcggcgacgaggctgaaacgcacgcgatcttccatctgacggctcagcacctgccagtgatggaactgctgggtgtgcgcacggcttgccgccgtctccaggcgagcaggcaggtcatcctgcatatctccggcaaacagaatacggctctcttcgaaatcatcactgtggcgcagcaagacttcacttgccggggtaaacgcagacattaaacactcctcattaaactcaggcggcgattatagtagtttgttggcgcagatacgacgaatttgctatatttgcgcgcctgacagacaggagtgatccgctatgacatcccgacgcgactggcaactacagcagctgggcattacccagtgggctttgcgcaggcccgcggcgttgcagggcgaaattgcgatttcgctgccggcgcacattcgtctggtgatggtgtcctctgcgctgccggcgttaaccgaaccgcttatcagcgacgtgctgcgggcgcttaccctctcgcccgaccaggttttacaaattacgccggaacggatcgcgatgttgccaccgggcagccgctgtaactgctggctgctgggcgctgacgaaaccgtggcgcttgaaggcgtgaaggtaacgtccccgctcttcgatgaattacgggttaaccctgcggctcgcgccgccctatggcaacaaatctgcgaacatgaacacgatttcttccctcaccacgactgatttggcagcggcttttcagatcgaaacccgcgcgcacgcctttccgtggagtgaaaaaaccttcgccagcaatcagggcgatcgctatctcaatttccggctgatggcgggcgacactatggtcgcatttgccattacgcaggtggtgctcgacgaagccacgctgtttaacattgcggtcgatcccgcttttcagcgccaggggctgggcaaaatgctgcttcagcatctgattgccgagctggaaaaacgcgatgtgctgacgctgtggctggaagtgcgcgcttcaaacgccgccgccatcgcgctgtatgaaagcctgggcttcaacgaagccaccgtccggcgtaactactacccgacggcaacaggccgcgaagacgcaatcattatggcgttgccgatttaacaagacgtaaggtgatgtaatgaactgggactggattttctttgacgccgacgaaacgctgtttacctttgattcgttcggcggcttacagcggatgtttcttgactatagcgtgacctttaccgctgacgatttccaggactatcaggccgttaataaaccgctatgggtggaataccagaacggcgcgatttctgccttacagcttcagcaccagcgttttgaaggatgggcggcgaagcttaatgttccggcgggggatctgaatgacgcctttcttaacgcgatggcggagatctgcaccccgctgccgggtgcgctatccctgctgaaatcgctgaaaggtaaagcgaagctgggcattatcaccaatggctttaccgctttgcaggaaatccgccttgagcgtaccggactgcgggactatttcgatctgctggtgatttctgagcagatcggcgtggcgaagccgcatccgaagatttttgattatgcgctggcgcaggcgggtaacccggcgtgtgagcgggtattaatggtgggggataccgccgagtcggacattctgggcggcatgaacgccggattgtccacctgctggcttaacgcccatcagcgcgcattaccggacggtgtgactcccacctggaccgtgacctcccttggcgaactggagcagctgctgtgtaaacattgattgtctgtcctctattgatgggtaaaatagccgcaatttgaatttcatgctgcgtggctttgcgccgcgcattgactaagaagaatatcattatgacgttgtctccttatttacaagaggtggcgaagcgccgcacgtttgccattatttctcacccggacgccggtaaaaccaccatcaccgaaaaggtgctgctgttcggacaggcgatccagaccgccggtacggtaaaaggccgtggctcgaatcagcacgcgaaatctgactggatggaaatggaaaagcagcgtgggatctcgatcaccacctccgtgatgcagttcccgtatcacgactgcctggtgaacctgctggatacccccggccacgaagacttctccgaagatacctaccgcacgctgacggcggtggactgctgcctgatggtaatcgatgcggcaaaaggcgttgaagatcgtacccgtaagctgatggaagtgacccgtctgcgcgatacgccgatcctcacctttatgaacaaacttgaccgtgacatccgcgatccgatggagctgctggatgaagtggaaaacgagctgaagattggctgcgcgcccatcacctggccgattggctgcggcaagctgtttaaaggcgtctaccacctttataaagatgaaacctatctgtatcagaccggtaaaggccacaccattcaggacgtgcgcattgttaaagggctgaacaacccggagctggacagcgccgtgggcgaagacctggcgcaacagctgcgtgacgagctggagctggtgcagggcgcatccaacgaattcgatcaggatctgttcctcgccggtgaaatcaccccggtgttcttcggtaccgcgctgggtaacttcggcgtagaccatatgctcgacggtctggtggactgggcgcctgcgccgatgtggcgtaaaaccgatacccgcaccgtggaagcgaaggaagagaagttctccggcttcgtgtttaaaattcaggccaacatggatccgaagcaccgcgaccgcgtcgcctttatgcgcgtggtgtccggtaaatatgaaaaaggcatgaagctgcgccaggtgcgtaccggtaaagatgtggtgatctccgatgcgctgacctttatggcgggcgaccgttcgcacgttgaagaagccttccccggcgacatcatcggtctgcataaccatggcaccatccagattggcgataccttcacccagggcgaaatgatgaagttcaccggtatcccgaactttgcccctgaactgttccgccgtattcgcctgcgcgatccgctgaagcagaaacagctgctgaaagggctggtgcagctctctgaagaaggggcggtgcaggtgttccgtccgatctccaacaacgatctgatcgtgggcgcggtgggtgtgctgcagtttgacgtggtggttgcccgtctgaagagtgagtacaacgtggaggcgatctacgaatccgtaaacgtcgccacggcgcgctgggttgaaagcactgacgttaagaagtttgaagaattcaaacggaagaacgaaatccagctggcgctggacggcggcgacaacctgacgtatatcgccccgaccatggttaacctcaacctgacgcaggaacgttatcctgacgttcagttccgtaaaacacgcgaacactaatcccggcccctcagagcgcggcagccgccgcgctcaatgactttccctgtcttattagcctcttgcggaatgttcttaattaccccgctttttcagtttgttgcttattttttagtctttcgcgcaagcgcttttaattttgttagctatatttaacaaagtggttaccgaaggggtggctgaaagcactgttcaatgcgtgaatactgacctttcatcctggcttaacggataaccataatattaataactggagcaggccagtgcgccacgggacatcatgattatgtgaccgatgccattgaaatctgcatttggtgagcttcaccacagcaacgaagcagccagtagggccgcttgacgccccggtgcgggcaaactgaaaggaataaatcgatgactatgacaagactgaagatttctaaaactctgctggcagtgatgctgggttccgtgctggcaagcggttctgcactggcagaaaccagcgccaccgataaagcgcaatccaccgcaagcgacgcagggcaaaaaatcgatagctctatgaataaagtcggtaacttcatggatgacagcgccattaccgccaaggtaaaagcggcactggtggatcatgagagcatcaagagtacagatatttcggtggaaacggataaagcggtcgtaacgctgagcggtttcgtcgaaagtcaggcccaggctgaagaagcggttaaggttgccaaacaggttgagggcgtagcttctgtaagcgacaaactccacgttcgtgatggcaaatccgaatccgttaaagggtacgcaggcgatactgcgaccaccagcgaagtgaaagccaaactgttggctgatgacatcgtcccatcacgtaaagtgaaagttgaaaccacggatggcgtggtacagctgagcggtacggtggattcccaggcacaaattgatcgtgcggaaagtatcgccaaagcggtcgatggtgtgaaaagtgtgaagaacgaccttaaagcgaagtaatgcattgcccggttaatgccgggtcttgcaggcaggataccgaaaaaaatcgcagtgagtagcctgagcgctcacgagcagcggtcgacattaattatggtaaaggagagtcatatgtttcgttggggcattatatttctggttatcgcgttaatcgccgccgccctgggcttcggtggtttagcaggtaccgcagcgggtgcagcaaaaatcgtatttgttgttggtatcattctgttcctggtcagcctgttcatgggccgcagacgtccatagcagtttgacataccccgatacatcgcaaagccagtcctcgtgactggctttcgttgtttcagaggcgttaaaattgcgctactttgtaagacacaataatttaacagggtgacagggtgggacagcgaattccggtaacgctcggcaatattgcaccgttagcgttacgtccatttcgcccgggtcgactcgcgctggtgtgtgaaggcggcggtcaacggggcattttcacagcaggcgtgctggacgaattcatgcgcgcaaatttcaacccctttgacctgtacttcggcacctccgccggggcgcaaaacctctcggcgtatctgtgtaaccagcctggctatgcgcgaaaagtcattatgcgctacaccacctcgcgggaattttttaacccggtgcgcttcgtgcgcggcgggaatcttatcgatctcgactggctgattgaatccaccgccagccagatgccgctcgccatggacaccgccgcccggctgttcgacagcggaaaatccttttacatgtgcgcctgtcgcggcgatgacttcacgcccggctacttttcgcccaccagccagacctggctggatctgatccgcgcgtcgagcgccattcccggcttttaccgtcccggcgtgatgctggaaggcattaactatctggatggcggcatcagcgatgcgatcccggtgcaggaagcggcgaatcggggggcgcagacgattgtggtgatccgcaccgtgccatcgcagatgtattacaccccgcaatggtttaagcgtatggagcgctggctgggcgacagcagcctgcaaccgctgatggcgctggtgcagcatcatgaaaccagctatcgcgccattcagcagttcatcgaaaagccgccgggaaaactgcgcatctttgagatctacccgccacgactgctgaaaagcatggcgctgggcagccgtctgcctgcgctgcgggacgactacaaactgggtcgtctttgtggacgctacttcctggcaacggtcggcaaactgctggcggaaacgccgccgctgttgcgccatgccccgcgcattgtgacgccgccagccgtcaccgtaccgcctaccgtcgtggtgccgcccgccgcggtcgccaacgatgccattaccacaccgctggtggatgcgcctcaggctaacgatgacaccagctttaacagtgaggggacggcgtgacattgcgttttatcgacacccactgccactttgattttccgcccttcaccggcgatgaaagcgccagcattgcccgtgccgccggagcaggcgtggaggccattatcgtgccctcaacggaagcggcgaattttgaccgcgtgctgaggctggcccgcgagcacgaggcgctttatgccgcgctcggcctgcatcccattgttattgagcagcataccgatcgctgcctgcaacagctggaggcgcaccttgccgcccctgatccacggctgatcgccatcggcgaaatcggccttgatttgtatcgtgacaacccgcagtttgatcgtcaggaacagatcctggacgcccagctggcgctggcgaaacgctatgcttttccggtgatcctgcactccaggcgcacccacgataagctggcgatgcacctgaagcgccacgcgctgccgcgtaccggcgtggtacacggttttgccggtagcctgcaacaggcgcaacggtttattgagctgggctattacatcggcgtcggcggcaccatcacttatccacgcgccagtaaaacccgcgacgtgatggcgcgtctgccgttatcggcgctgctgctggaaaccgacgcgccggatatgccgctgaacggttttcagggccagcccaaccgcccggagcgggtggcgcaggtgtttgagtctttgtgcgaactgcgcccggaagcaccggaagcgatcgccgaaacgatatttgccaacacccgccgtctgttttttacagataaagcgcaggcagaataatcttctccacgcccctttcccgcagcgccgccgccagcggttccacatccaccggggtggcgctgtgccattgtgccgcctcgccataaacgccgtgggcatgaaaggcgttcaggcgcacgctgacgtcgccgaggctgacaataaaattgctcagttctgtaatgtgttgcaggtaatcgctgtggcccgggatcgccagcagccgtagctcggccagtttgccgcgcgccgccagccagcggatgctctctttcacccgcgcgttgtcccgcccggtcaactggcggtgaatgtcgttgtcccaggctttcagatcgatcatcgccccgtcaaataacggcagcagtttttgccagccggtttcactcagcagaccgttgctgtccaccagacagctcagcgttgacagcgcgggatcggcttttatggccgcaaagagttgcagtaaaaagggcagttgcgtggtggcctcgccgccgctgacggtaataccgccgataaatgcgcgcacttttttgatctgcgcgataacctccgccacgctcatgcgctgcgccatcggcgtcgcccgttgcgggcagcgccgtaagcaggtgtcgcactgctgacagacggcttcataccatgtcacctgcccgttaattatcgacagcgcctgatgtgggcagtgcggcacgcagtcgccgcagtggttgcagcgccccatggtccaggggttatggcagtttttacagcgcatggagcagccctgtaaaaacagcgccagccggctgcccggcccgtcgacgcaggagaaagggatcagcttactgactaaagcgcatctgctgttcatggctgaccacgcggggttgacgttccagcatgcgcgtattgcgcgcggcttcttcacccagccaggtggtattggtgcgcgatccttccgcgcggaatttttccagatccgacagtcgcaccatatagccggtaacgcgcaccaggtcgttgccgctgacgttggcagtgaactcccgcatcccgaggctgaaagccccgagacagagttgcatcaccgcctgcgggttgcgtttgatggtttcgtcgagggttaaaatgtcgctgatgcccgccgcgtaccaggcatgatgcggcgcgacggtctgcaaatgggtgatgggatccggctcttcgccgtacggcaggcgcgcccccggcgtggtgagggtatcgctgctgatgccggactgcgcatgcagcatggcgcgctgctgccagccgtgcttcaccggcgtgcgggcgacaaaatccgccagatgttcgctgatgcggtaagccagttgattcgccgcctcgtcctgcccgtagcggcccgcgctaccgcttttctcactcagggtgttcaccgcttccgcaaggccgtagatgccgaacatcggcacaaaacgttgtggatcgatcagcccctcttttaccaggaagctatgctcaaagaaacgggactgctgataaaggaagtcgcagcgcgcatcaataatggcgatctgctgtgcgcagtagtgcgccagcgtgcgattaaaaaagtcgtccactgacgcgctgcgttcggcaacggccttcaggtttagcctgaccagcgtgctgccgccccccgccagcggcagcgagttgtaacagctgacaacgccgtagccgccttttgtgaaaattctatcatttaccgggccgttggaaatatgcggtttactgcactcacagatgttttccgccaccttcagcagcagtgactcgggggtaatttcaggatcataaataaaggtcagattcggcgaaacctgctttaactctgcgtcagcgcgtaaaatggcgcgggtgaccggcgtatcctgcgggccgatattggcatgcataaaggcatccggcagggtgcgatccagatagcgccagaaacgttttatgcgactatcgatttcgtcttgtgttagaattctaacataaggttgcagcagggcatcaaggtggccgaggaacaccggcatcgaagtgaccgacggcacatggtgataaagaatggtgagcatcgacagcgcatcgtcgaaatcttttgccggttccagcttcagccattccgaaccctgcgccagaaatttcgcgtaatcgggcagcacatagcgcggtttgtaaggcgcgttgccctcgaacatatcgcatatcacgccgtcatccagcgccgcacgcgcggcctggggtaaggcgggataaggcagagcgttttccgcctccagcgccagaaaatgtcgcttttgtgcggatgagagtacagggcttgtcacaatttgctggcaacgttgcagcatcgtttggggcgcagacgcgggcatgggctttcctcgggttccttgagtgaggcgggcagtgtaagaaatgccggatgcacgtcttttgatcctgatgggtgcgcagcggaaaaaccctggccctggtgctgaaaaagttgatctgaatctcatatcagttatgcaaatgtgaatgtcgttttcattaactgtgatgaatgtcgaagtgtcgtggcgggtgaatgttagaatactcacacacccgccggaataaatgttaaccggagaatgttatgactgatttaaccgcaagcagcctgcgcgcgttgaaactgatggatctgaccaccctgaacgacgatgacaccgatgcgaaagtgatcgccctgtgtcaccaggcgaaaaccccggttggcaacaccgccgcggtttgcatctatccgcgctttatcccgattgcgcgtaagacgctgaacgagcagggcacgcctgacgtgcgcatcgccaccgtgaccaacttcccgcacggtaacgatgacattgagatcgcgctggccgaaacccgcgccgccatcgcctatggtgcggatgaagtggacgtggttttcccgtaccgcgcgctgatcgccggtaacgagcaggtcggttttgacctggtgaaagcctgtaaagacgcctgtgccgcagcgaacgtgctgctgaaagtgatcatcgaaaccggtgagctgaaagaagaagccctgatccgtaaagcgtctgaaatcgccatcaaagcgggcgctgactttatcaaaacctccaccggtaaagtgccggtcaatgccacgccggaaagcgcgcgcattatgatggaagtgatccgtgatatgggcgtggaaaaaaccgttggcttcaaaccggcgggcggcgtgcgtacggctgaagatgccgcgcagtttctggctatcgccgacgagctgtttggcgctgactgggctgattcccgtcactaccgtttcggcgcgtccagcctgctggcaagcctgctgaaagcgctgggccacggcgacggtaaaagcgcaagcgcgtattaagtagttatttgccagaccacaggccgggtaaggcatcaccgccacccggcatgtcatcgtaacgccgggtggcgcgttgcttacccggcctacagactggccttcgactctttttcctcagggggttcccttgtttctcgctcaagaaattatccgcaaaaaacgtgacggcatcgcattaagcgatgaagagatccgcttttttattaacggcattcgtgacaataccgtttccgaaggccagattgcggcgctggcaatgaccattttcttccatgacatggcgattgaagagcgcgtctcgctcaccatggcgatgcgtgattccggcagcgtgctggagtggaaaagcctcaaccttaacggcccgattgtagataaacactccaccggcggcgtgggcgatgtcacctcgctgatgctggggccgatggtcgccgcctgcggcggatacattccgatgatttccgggcgcggcctggggcataccggcggcaccctcgacaagctggaagccattccgggcttcgatattttcccgaacgatcaacgcttccgcgagatcatcaaagacgtgggcgtggcaatcatcggccagaccagctcgctggcaccggcggataaacgtttttatgccacccgtgacattaccgccacggtggactccatcccgctgatcaccgcctcgatcctcgccaaaaaactggcggaaggtctggatgcgctggtgatggacgtgaaggtcggcagcggcgcctttatgccaacctacgaactctctgcggaactggcgcaggcgattgttggcgtggcgaacggtgcgggcgttcgcaccactgcgctgctgacggacatgaatcaggtgctggcctccagcgccggtaatgccgtggaagtgcgcgaagccgtgcagttcctcaccggcgaataccgcaacccgcgcctgctggaagtgaccaccgcgctgtgcgtggaaatgctcatttccggcaagctggcgaaagatgacgccagcgcccgtgccatgctgcaaaacgtgctcgacaacggcaaagcggcggaaatctttggtcgtatggttgcagcccagaaaggcccgaccgattttgttgaaaactacgacaagtacctgccgacggcaacgctgaccaaagcggtttatgctgataacgaaggcttcgtgtcagacatggacacccgcgccctcggcatggcggtggtatcgatgggcggcggtcgccgtcaggcctctgacgccattgattacagcgtcggctttaccgatatggcccgactgggcgacagcgtggacggtcagcgtccgctggcggtcattcatgccagagacgaaaacagctggcaggaagcggcccgcgcggtgaaagccgctatccgcatcgatgaccgcgcaccggcggaaaccccggtggtatatcgcagaattactgaataaccgcccggcgagcttcccgttacaggaagagttcgggtatactgatctgatcgcttttttacagcgcgcaaggtacggagaaactatgaaacgtgcatttataatggtgctggactcattcggcatcggtgcgactgaagatgcggagcgctttggcgacgtaggttcagacacacttggccacatcgcagaagcctgcgcaaaaggtgaagctgaccagggtcgtcagggtccgcttaatctgcctaacctgacccgtctgggtctggcgaaagcccacgaaggttccaccggcaagattgcggcgggtctggacggcaacgcggaagtgatcggcgcgtatgcctgggcgcatgaactctcctccgggaaagacacgccgtcgggacactgggaaatcgccggtgtgcctgtgctgttcgactggggctatttcagcaacgagaccaacagcttcccgcaggagctgctcgacaagctggtggaacgcgcaaacctgccgggttacctcggtaactgccactcctccggtacggtgatcctcgaccagctcggcgaagagcatatgaaaaccgggaaaccgattttctatacctctgccgactcagtgttccagatcgcctgtcacgaagagacctttggcctggataagctgtatgagctgtgcgaaatcgcccgtgaagagctgaccgaaggcggctacaacattggccgcgtgatcgcacgtccgtttatcggcgacaagccgggcaacttccagcgtaccggtaaccgtcacgacctggcggtagagccaccggcgccaaccatcctgaaaaagctggttgaagagaagaacggccaggtggtttccgtgggtaaaatcgcggatatttatgccaacgtcggcatcaccaaaaaagtgaaagcgaccggtctggatgcgctgtttgacgccaccgttaaagagatgaaagaggcaggggacaacactatcgtgtttaccaactttgtcgattttgactcttcctggggccatcgccgcgacgtggcaggctatgccggtggtcttgagctgttcgaccgccgtatgccggaactgctggagctggtgggcgaagatgacattattatcttcaccgctgaccacggctgcgatccgacctggaaaggcaccgatcacacccgcgaacacattccggtactgatctacggcccgaaagtgaaaccgggctcgctcggtcaccgtgagaccttcgcggacatcggtcagacgctggcgaaatactttggcacgtccgatatggaatatggcaaagccatgttctgatacccgttgccggatggcgctacgcttatccggcctacgaggaagcgtttgtagttatgtaggccgggtaaggcgcagccgccacccggcaaaattttaaaaaggaatgaaagatggctaccccacacattaatgcagaaatgggtgatttcgctgacgttgtgctgatgccgggcgatccgctgcgtgccaagcacatcgcggaaaccttcctggaagacgcgcgtgaagtgaataacgtgcgcggcatgctgggctacaccggtacttataaaggccgcaaaatttccgtaatgggtcacggcatgggtatcccgtcctgctccatttacaccaaagagctgatcaccgatttcggcgtgaagaaaatcatccgcgtcggctcctgcggtgcggtacgtgccgacgtaaaactgcgtgacgtggtaattggtatgggtgcctgcaccgattccaaagtgaaccgtctgcgttttaaagatcacgacttcgcggccatcgcggacttcgacatggtgcgtaacgcggttgacgcggctaaagcgctgggtgttgatgcgcgcgttggtaacatcttctccgccgatctgttctacaccccggatccgtccatgttcgacgtgatggaaaaatacggcattctgggcgtggaaatggaagccgcgggtatctacggcgtggcggcggaattcggtgcgaaagcgctgaccatctgcaccgtgtccgaccatatccgtacgcacgagcagaccactgccgctgagcgtcagaccaccttcaacgacatgatcaaaatcgcgctggaatccgttctgctgggcgataaagagtaagatctgttgtgccgggtggcggcttcgcctgacccggcctacggtttaccaggcccgctaagcgtatcgcaagcgggctttttattagcgcactgccccggcaatccacgccgacaactcccgcagttctttttcctgctcaggatagtccgcaatcaacatctcacacacctgttgcagccgatcggcgcgatacagacagccctgcaaacgtgtcgccagcgcctctaacggcgcggggttcaggctgtcggtgaacacctgcgtgcgggtgatatggcctttttccacgtcgaaatgcagctccacgccgccccaggtaaagcgctcgtccagcaaatggctgaaggccggggcctggccaaagttccattcccaactgctctggcgggcaaaggtttccgcgaagttcggcagatccggcgtcttgtccggagagatgatctccgcgtccacgctttcaccgtagtgctcaaaaaaggcgcgggtgacagcttcgcagatcgcctcatgggtgatgccgggcagcagatcgacaaggttcgccacccgcccgcgcaccgaggtaatgcctttcgcctgaagctttttcttgtccgggttcaggtaattcgccagacggctgagatcggcattcagcagcagcgtgccgtgatgaaaaccacgatccggcgtctcccggtaggcggagccggacactttacggtcgccgtccggggttttcaccaccagatcgttacgcccggaggcttccgccgtcgcgccaagggatcgcagcgcgtttaaaacgatggccgtggaaatgcttttatcgtattccggcttacccgccataaaggtaaagcaggtattacccagatcgtgaaacaccgcgccgccgccgctgctgcgacgggcaaggcgcacatgatcctcttccatacgccgggtattacactctttccacggattctgcgcccggccaatgaccacggtatccgcattgcgccacaggaacagcacgcgctgggtggcgggcatctggcggaaaatgcactcttccaccgccaggttaaaccagggatcgtaagagtcagaaatcaataaacgcagggtggacatagccagtctcctttatacggtgtcccgtcagggttcctttttatcacgctcttcttcttccggcaccgacttgctggccgtcagcaggaagggggattgctgccagcgggtgcgtttaccctgcaacagggtgcgggtcagcaccacgccgatggcgagggagagcagcagcatcaggcgtaaaatattggtggtgttatccacctgtttcgcttcggtcgccagcgtatgggtatccagcgtcaggcgcagatagcccagcgggccatttttacccggcaccggttcgacaatttgctggttaaaatagccgcccgcttttttgccatccagcgccagccggtcgcgtacatcgacgctttcgcccgcgcggaccaccagatcgccctgttcgtcatagacgcccgcatccagaatgcggctttcgtcggttaactgacgcaggatctggccgatacgtttttcgtccggcgtttcactgcgcatcagcggcgcgagattcagcgtcacctgacgcgccagcgtgcgggccagctcctccagctgcggattgcgcgcccgctggtggctctggctgaaccagctggccccctgcatcagcgccaccagaagggcgagacagatcaggacaatcacggcgcgatgcagccggaattttaattttgcgcgagccatagtctacctgttgaaaattttacgcttccgctgcggcataacggtccgcgctttgaatgcatggtcgatgcaccgggtgatgctacccatgataaacccttgtgtaatgacaaaggtcgttacgattgttgcatggggttgggaggagggcaaggtgagggggattgcttaaatgttgtccgggatgagcgagaagcggatataatcatcaggtgtaatccgcttaaaaacaagtgcctgtgttaatttgtaagcgaagccgttaagcaaaaacaatgtttaaataattagtggagagatcatgggcgtagagttccatataacacgagctgatttttgggcggataatgaagaagcccaaataacgcctgaggagtggctttcccttatcgatagcgacagcgaattaacgataaaccttaaaaatggcgactatcatgctttgtggtcaggtgcttcatcgcacgatgaggcatggcttgactggagcgatggcaatatctacaccaaatggccagacacgcagctatacagaaagatgttagatatcgctgggcgcctcaacgctcgggtaatggacgacgatggtaatatttacagcgccccatctgactgggagtatgaaccttcttctactgattaacgtccgcttcgggcgtgaaacagacgagctaactgagttgatggtccgccatgagcgaggaacagacatttacttaactggatgccaaaagacttcatactatagctcatccattatggttgacttgaagcggcagattattcaagctgcgaagctgatcattatcatacagatggttgagtcgggagttttcaggaatggaaagacatcgcccacatggtcgtaccgtaaccgcattagaagcagatgtacttaaacttcgggcactagaaatggtcttggtgcttttctatgtggaaaacctgaaagattttattagcagttctgttaacgtcacaaaaaggttaagaaaaattattgacagtacgcaatctacagcaaatgaccaaaagaaaattagctttaaagaagcacatgaattactcctttcggaaggagtcataacacaagaagaaagcttacaattgatagaaatgattgactaccgtaatactataggccatgagatccacagaataacgatagatgttggagcatacgctaatcttggtgagcaggatcttcctaacggacataaaatagcacaatataattactcagctgtccagcacatacagaatcttagaaaaaatatagaagaaaaaatgatggataaatcattttgctttgaactatctttcgacgctttggcatttaatgccgccgagcaaacatatcttaaagaaattaagagattaaagaaaaaagttaacgaccaaattaataagttgaacgttactatagatgctacgaatgaaataatcagaagaattccgcatgaagttatggatgctgtacagcccggccatccgaaaaacaccaagaacaatggcacatttagcccagaaggtacgaaaggaatgttcatgttatatgatgcaaaagccagtccgttggcagttgcttatataatgaggatatcatatcgcactgctttaagatggtataaaaagtggagtgaaaatcataaaaaataagtaaggcggatgaattttaaattaaacaccatcgtatataaatattgctttatttcatgtgggttctttattttatcttttttttgacatattaatgtatatggattgaaattacctattagcatccccatgatagcttcactcttatttgagattttcactaagttattgacgggatttgatacttgtaatgtccgtttccaggcaagaatcggacacgtaacctgatttaaagttccgctgcgggcgagggcggccattatatttagtgctactttctaacattaatgcacatcaagaaaaattaaagagataacagaccgatttgaacaaggcctgttatccggaatgtttattaatatgaggtatttttttcaagaatatacagattctgttaatccatccaaacattctataacaaaacgcttggcctcttggttatctctcactaaggtcataattttagtttcataaaatgcacggtttggacagttaagcctgcgaataattttatctatcataccagttcgcctaattgaatatctttctatcaagaaactaacgtcttttcgttcaagagcatcttcataaatcgatagctcattgttataaatatctccagcattgattgatacggttttattttcgaagccggctctatgacttggtattaactgattaaacatccatcttactgatttattaaccgcaaggctacataaatccttcttttttgaagaatcaattaatacggtaagaatatctttcttaatatcattcataactgaatcatcaatttcaaaaatatcaccgtacttttttataaagaactctatcattacagggtgatagaatattgattcaatagagtgatatttaagagtaaagataaaatcactttttaagctatcaatttcttctgctttcttattatcattgtcaaccaaaccaaatgcattaacccatcctagcttatcattacctctgatgcctctgaccgaaatagctacatcttcacacccctccttcgggattaacgaaacatcaggaaaaactgatttataaagtcctatatcaagacttgagtttattccctctatgaaaataactttctcttttgcaccgataatatctttttttatgtgatcaggaattgaaccgggatctcttataagttccgtttcccacgaggttgcgatttcagaagtatatttacacgactttaccaaaaggatttgtgaattatccatatctgaagcaaggcctatgtcgtgtgttgaaacaatgaaaaagcaatcaggcctgattgctatcagttctgatagcaagggagatgaaacagacctatgtaaatgcctttcaggctcatcaataataaaaagagtacctggcaatgctgatataacatcagcggatatagttatggcatttttctcaccatcagataattgagatatagagtaaattgctggcggattatattttgaattcactgctgtaatattatcttcatcatcgtgttctatagtgataggcattcctgatgatattaaaactgaattaattatttctttaggtgacacactaaccttcagcgctccatctatgtctcttgcgtctactttatcggcaacatctctatttcttctattaattgctttttttaatctaatgacaggaagtttgctttgtcttgcatcatcgactttccaacgagaagtgtttgaatatcttacattgctttgaagatattctaaagtagaagcaaactccgaattcgacatatcaataaccgatgtgtcaaaccaaatttgcctatgtgcagatatcaatacgatattattataatctcctaggttttttagtacgtgataaattagtgatgacttgccagcgccgttagctccaagaatgaaaagaacctgtccttgatagataggcaataatctaccttcaatgttctctgaaggaataggaatattaacatgcttttccaagtttttctcctaaactaggtagagctactattatttatatcgatccattgtattctaatattttggcagtcgccaccttactttacttacctcttgtagctagagttatctgctcgtattgaatcggcatgtctatattttttgataggaccgtgtctttaaacaataactcagttagctcgcccgctcctgccacaaagccgtccttgaaccaggtgccagaccattaccgatcccaggatattctacgggtcgtacagacatcagcccatctttcaaacacctttgcgagccgctacgcaaaccgtacagctaaatccgcttgccgttaaccgactccggcagtagcatcttcccgcacctgcaaaatcaggtgccgggattagcctccacgaattgttacaggcgacataatttttatgtcgtgcgttcggctacacctcaatggtgggccgggcgagggcgtcgcaagacgcgccggtttcctgtaacaccggtaaggctaacctcgtccggttccgccacccgtgggattagcctctccgctggcggaatattaaaccgttacaggagactgccttatggctaccatccccgatcagttgtacccgttacttaccgttccttttactgctgacaccgatttcaccgtgctggcggatcattgcgagcacttcgccgaagcgctgattgaaagcgacgatccggcgctgcgcctcgccatgtgcggacggctcaatgcctgcctgatgctgctccagcccacgctgaatgaggtgataccgccacatctggttgcggcgctcacggtggatacgccgcctgcggaaccgccccgtttcgaaccggaatctgacctgttatgtgaatactgtcttacgttaacgcgcgtgctcaacagccagtcgctgccgccggacatggaaaaaaccctcaccgggctgctctgtgaactggtgtggtatttcacggacatcatgaaagccccgcgctgggtgcgaacgcaggcgggcatgcaggaactggaggcgtagcgtatcggtaaaagccctgccgggtaccctctctccgggcccggcagcactgcacaattccacatgaagctgttgccagaagcgatggttacagggtagcctcatgcgttattttccttatacccgtcatacttcaggttgcaggtgtgttggctttcctcgttcaccccggtcacttacttatgtaagctcccggggactcactgcgtcgccgccttcctgcaacccgaattattcagggtaaagacaatttccgacgcgaacgtgtaaacaggagcattaatgcttaacagtctgacctggtgcgatctgcctgaagaggtttctcagtggcctggattgccgctctcgttaagtggcgatgaggtgatgccgctggattatcatgccggtcgcagcggctggctgctttacggtcgcgatctgaataaagcgcgcctgacggagtatcagcgtaagctgggcgcagccatggtgattgtggcggcctggggcgtggatgagtaccaggtgatccgcctggcaggctcgctgacgccgcgcgccacccgtctggcgcacgatgccgggctggacgtcgcgccgctcggcaagatcccgcacctgaaaacgccaggattactggtgatggacatggactccaccgccatccagatcgaatgcattgatgagattgccaaactggcgggcaccggcgaaatggtggcggaagtcaccgaacgcgccatgcgcggcgaactggatttcaccgaaagcctgcgcagccgcgtggcgaccttaaaaggggccgacgccaatatcctgcgccaggtgcgcgatgatttaccgctgatgccgggcctcacgcaactggtgctgaagttacagtcactggactggaaagtcgccattgcctccggcggtttcaccttcttcgccgattacctgcgcgacaagctgcacctgacggcggtggtcgccaacgaactggaaatcatggacggcaggctcaccggccatgtgctgggcgacatcgtggatgcgcagtacaaagcgaaaacgctgaaacgtctggcggaaaaatatgacgtgccctttgagcagaccgtggccattggcgatggcgcaaacgatctgccgatgattaaagcggcagggctgggcattgcctatcacgccaagccaaaagtgaacgaaaagacagaagtgacgatccgtcacgctgacctgatgggcgtgttctgcatcctgtcgggcagcatgaatcagaaataacgaggtaaaagtggcaaaagctccgaaacgcgcatttgtatgtaatgaatgtggtgccgattatccgcgctggcaggggcagtgcagcgcctgtcatgcctggaacaccatcaccgaagtgcgtgtggcggcatcgcccgtggttgcccgtaacgagcgcctgagcggctatgccggtaatgcgggcggctcgaaagtgcagaagctctccgagatcagccttgaggaattgccgcgcttttccaccggctttaaagaatttgaccgtgtgctgggcggcggcgtggtgccgggcagcgcaatacttatcggcggcaaccccggcgcgggcaagtccacgctgctgctgcaaacgctgtgcaagctgtccgagcagatgaaaactctgtacgtcaccggggaagagtcgctgcaacaggtggcgatgcgcgcgcaccgtctgggcctgccgacggcgaatctcaatatgctgtctgaaaccagcattgaagacatctgcactatcgccgatgaagagcagccgaagctgatggtcatcgactccatccaggtgatgcatatggcggatattcaatcgtcgccgggcagcgtggcgcaggtgcgcgaaggggcggcctatctgacgcgctacgccaaaacgcgcggcgtggccattgtgatggtcggccacgtcaccaaagacggctcgctggccgggccaaaagtgctggagcactgcatcgactgttcggtgctgctggacggcgatgccgattcccgcttccgcacgctgcgcagccataaaaaccgcttcggcgcggttaacgaactcggcgtgttcgccatgaccgagcagggcctgcgcgaagtgagcaacccgtccgccatcttcttaagccgtggcgatgaagttactgccggcagttcggtaatggtggtatgggaaggcacgcgcccgctgctggtggaaattcaggcgctggtggatcagtcgatgatggctaacccgcgccgcgtggccgttggtcttgagcaaaaccgtctggcgattttgctggcggtgctgcaccgtcacggcggcctgcaaatgtcggatcaggacgtgttcgttaacgtggtcggcggcgtaaaagtcaccgaaaccagcgcggacctggcgctgctgctggcgatggtctccagcctgcgcgaccgcccgctgccggacgatctggtggtgttcggcgaagtggggctggcgggcgagatccgcccggtgccgagcgggcaggagcgtatctcggaggcagccaaacatggcttcaaacgcgccatcgtgcctgcggccaacgtgccgaaaaagccgcctgccgggatgcaagtctttggtgtcaagaagctttctgatgcgctatctgtttttgacgacttataatgatttattaagcggaaactaaccgcactgatgcaggaggcacctatgtcgtcatttgattacctgaagaccgcgatccgccagaaaggctgcaccctgcagcaggtggcggatgccagcggcatgaccaagggctacctcagccagttgctcaatgccaaaatcaaaagcccgagcgcgcagaagctggaagcactgcaccgctttttagggctggaattcccgcgccgccgtaaatccgtcggcgtggtgttcggcaagttttatccgctgcataccgggcatatctatctgatccagcgtgcctgtagccaggtggacgaactgcatatcatcatgggctatgacgacacccgtgaccgcgcgctttttgaagacagcgccatgtcacagcagcccaccgtgccggatcgcctgcgctggctgttgcagaccttcaaataccagaagaacattcatatccatgctttcaatgaagagggcatggagccgtatccgcacggctgggacgtttggagccggggcatgaaagcctttatggaagagaagggcatcgagccgaaccggatctacacctccgaagcgctggatgcgccgcagtatctggaacatctgggaacggaaacgatccttatcgatccggaacgtacctttatgaacatcagcggcgcgcagatccgtgagaacccgttccgctactgggattacatccccaccgaagtgaaacctttctttgtgcgtaccgtcgccattcttggtggcgagtcgagcggcaaatccacgcttatcaacaagctcgccaacatctttaacaccaccagcgcctgggaatatggccgcgattatgtgttctcgcatctgggcggcgacgagatggcgttgcagtattcggactatgacaagatcgcgctgggccacgcgcagtacattgatttcgcagtgaaatacgcgaacaaagtggcctttgtggatacggattttgtcagcacccaggcgttctgtaaaaagtacgaggggcgcgagcatccgtttgtgcaggcgttgatcgacgagtaccgttttgacctggtgatcctgctggaaaacaacaccccctgggtttctgatggtctgcgcagcctcggcagctcggtggacagaaaagagtttcaggcgttactggtgtcgctgctgaagcaaaacaatatcgattttgtgcatgtggaagaggcggactacgacgcgcgtttcctgcgctgtgtggatctggtgaagcagctgatgggcgagcagggctaaataaatgcccctttcccgacgggaaaggggcaccggcattacttcgaaatacgcttgtacttgatacgcttcggctccagcgcgtccgcgccgagagtgcgtttcttgtactcttcgtattcggtaaagttaccttcgaagaattccactttgccctcatcctggtaatccagaatgtgggtggcgatacggtcaaggaaccagcggtcgtgcgagatcaccatcgcgcagcccgggaactccagcagggcgttttccagcgcgcgcagggtttcgatatccaggtcgttggtcggttcatcgagcagcagcatgttgccgccaacctgcaacagcttcgccaggtgcagacgaccacgctcaccgccggacagttcgcccacgcgtttaccctgatcaatccctttaaagttaaagcggccaacgtaggcgcggcttggcatctcggtgttgccgatacgcatgatatccagcccgccggacacttcttcccacacggttttgctgttatccatcgcgtcgcggaactggtcaacggacgccagcttcacggtttcacccagctcgatggtgccgccgtctggctgctcctgaccggacagcatgcggaacagcgtggatttacccgcgccgttcgggccgatgatgccgacgatcgcgcctttcggcaccgagaagctcaggccgtcgatcagctgacgatcgccgtaggatttgctcaggttggtaacctcaacgactttatcgcccagacgcggtccaggtggaataaagagttcgttggtttcgttacgtttctggtattcggtgctgttaagttcttcaaagcgtgccagacgcgccttacctttcgactggcggcctttcgcgccctgacgaacccactccagctctttctcaatcgacttacgacgcgccgcttcctgagaagcttcctgcgccagacgctgatctttctgctccagccaggaggagtagttaccttcccacggaataccttcaccgcggtcaagctccaggatccagcccgcaacgttatcaaggaagtaacggtcgtgggtgatcgccaccacggtgccttcgaagtcgtgcaggaagcgttccagccaggcgacggattccgcatccaggtggttcgtcggttcgtcgagcagcagcatgtccggcttttccagcagcagacggcacagcgcgacgcggcggcgttcaccaccggacagtttttcgattttggcatcccagtccggcagacgcagcgcatcggcggcgcgttccagctgcacgttcaggttgtggccgtcatgcgcctggataatttcttcaaatttaccctgttgcgccgccagcttatcgaagtcggcgtccggctcggcgtacttcgcgtacacttcgtccaggcctttcagggcgttaaccacttcggcgaccgcttcttcaacggactcgcgcacggtatgttcaggattgagtttcggctcctgcggcagataaccaattttcaggccaggctgcggacgggcttcaccttcgatgtcggtatcgatgccggccataatgcgcagcagggtggacttaccggcaccgttgagacccagcacgccaatttttgcgcccgggaagaaactcagcgagatatttttcaggatatgacgtttcggcggaaccactttgccgacacgatgcatggtataaacgaattgagccacgttggacttcgcctcttttatcgggatgtgaatggtctttaactgcgcagtgtagcggttttcacggcgcaatcccagcaggcccgggcgagagtgttaaatcacaccgaaaaggtaaaaaagtgtccggggcgtggcgcgataggggatgcctggttagcataaagtattcgcgcgcatgatgcggtgaagcgttttatttataagaggaaaagcctgtgcagaaagcaaaacacgtcgtctggcagatgctggtggtgggcagctgtttactgaccctcagccacacggcacgcgccgattcgctggacgatcagcgtaaccgttatgcgcaaatcaagcaggcgtgggatagcaaacaaatggacgtggtggcgcagctgatgccgaccctcaccgattatcccctctacccttacctggaataccgccagattactgacgatctgatgaaccagccggcgatcaaggtcagcaattttattcagtcaaacccaacgctgccgcccgcgcgtagcctgcaaaaccgttttgtgaacgagctggcgcggcgtgaagactggcgcggcctgctggcgttcagcccgcaaaagccgggcaccaccgaagcgcaatgtaactattactacgccaaatggaataccggccaggccagcgaagcctggcagggcgcaaaagaactctggctgacgggcaaaagccagcctaacgcctgtgacaaactgttcggcgcctggcgcgcctccggcactcaggatccgctggcctatctggaacgtatccgcctggcaatgaaagccgggaatacccaactggtgacggtgctggcgaatcagatgcccgcggaataccagaccatttcgacggcgattgtgacgctggcgaacgatcccaacagcgtgctgaccttcgcccgcaccaccggggccaccgattttacccgccagatggcggaagaagccttcgccagcgtggcgcgtcaggatgtggaaaatgcgcgcctgatgctgccgtcgctggtgcaggcccagcagcttaatgaagatcaaacccaggcgctgcgcgatattatcgcctggcgactgatgggcaacgatgtcaccgacgagcaggcgcgctggcgtgacgatgccattatgcgtacccagtccacgtcgctggtggagcgccgggtgcgtatcgccttagggcagggggatcgccgcgggctgaatacctggctcgcccgtctgccgatggatgccaaagagaaagacgagtggcgctactggcaggcggatctgctgctggagcgtggccgtgaagaagaagcgaacaccattctgcgatccctgatgcagcagcgcggtttctatccgatggtggcggcgcagcgtctgggggaagactatccactgaaagtggataaagcgcccggcaatatcgatccgacgctggtacagggcccggaaatggcacgcgtgcgcgaactgatgtactggggtctggataacaccgcccgcagcgagtgggccaatctggtcaccagccgcaccacgcaacagcaggcgcagctggcgcgctatgcctttgaacgtcagtggtgggatctgagcgtgcaggcgactatcgccggtaagctgtgggatcagctggaggagcgtttcccgctggcgtataaagatctctttgagcgttataccagcggcaaagatatttcccagagctacgccatggccatttcacgccaggagagcgcctggaacccgaaagtgcgctcgccggtcggcgccagcgggctgatgcagatcatgccgggcaccgcgacgcatacggtgaagatgtttaatattccgggctacagctcgccgggccagctgctggatccggaaaccaatatcaacatcggcaccagctatttgcagtacgtgtatcagcagtttggcaataaccgtatcttcgcctcggcggcttacaatgccggtcccggtcgggtgcgcacctggcttggcaacagcggtggacgcattgacgccatcgcttttgtcgagagcattccgttctcggaaacgcgtgggtatgtgaaaaacgtgctggcctatgacgcctattatcagtacttcatgggcggtaaaccgacgctgctcacggcgacggaatgggggcgtcgttactgatctgccgggtttgtgttatgctgctgtactcgttgatgagtatggcggtatgacatgacgcagcaatctccttattcagcagccgttgccgaacagcgtcaccaggaatggttgcgcttcgttgagctgcttacacaatcctgcgaacaggatttgcatcttccgttgctcaatttgatgctgacgccggacgagcgcgaagccctggggacgcgggtacggatcattgaagaactgttgcgcggcgaaatgagccagcgcgaactgaaaaatgagctggggaccggcattgcgaccatcacccgcggctcgaacagcctgaaggcggcgcccgccgagctgcgtgaatggctcgaaaaggcgctgcttaaagatcagcgataaacgtcgttgtgaaacggacttaacgccaggatcaccgcctgatggtagacgctggtacgcgtcagctttccggcggtgaacacgccaattgccccttctttacgtccaatctcatcaatgccggtgaactgcgacatcaccgggccaagcgcttccccggcgcgtacatgctcaagaatgacggcaggcagcggcagggtggcggaacgcgcttctccgcgctgatcgcggctttcaatcaccacccagctgaaggtgctgtcatcgtcaattcccgcttctatcgccacccagaaatccgcctgcggcctttcacggcgggcgttttcgacacgattacgtgcgccagcccgcgtttctgcgctgccgaacggctgttccggcacgccgctctcgacggcgacagactccatatggcaggatccttcgccgaaaatctcgtgaaatgcgtgcagaatagccttaattttcgctggattgctggtagctgagacaacatggtacataatcaatatcactcagatttataaatttgccccgcagtataatggaaaaaacgcatgttacaggtataccttgttcgccacggtgaaacgcagtggaacgccgagcgtcgtattcaagggcagtcagacagtccgttgacggcaaaaggtgagcatcaggcatggcaggtgggcgaacgggcgaaaacgctcggtatcacccatatcatcgccagtgatttagggcgcacgcgtcgcacggcggaaattatcgccgatgcctgcggctgcgacattatttttgacgcccgtctgcgtgagctggatatgggcgtgctggaaagccgccatatcgattccctgacggaagaagaagagggctggcgtcgtcagatggtcaacggcaccgcagaggggcgcattccggatggcgagtccatgcaggagctgagcgaacgtatgcatgcggcgctggcagcctgtctggatctgccgaaaggcagccgtccgctgctggtgagccatggtatggcgctgggctgtctggtgagcaccattctggggctgccagcctgggctgaacgccgcctgcgtctgcgcaactgctctatttcgcgtatcgattaccaggaaagcgcgtggctggcttccggctgggtggtggaaacggccggagacgtctcgcatctggatgctccggcactggatgagctacagcgttaacgacgcaccgggatcaggtattcgcagcgcagttcaatcggccgctcctgattccgggcctcatcctgtgggaagaagcgctctatatccagccccttgcggcgggtgagatccagcatcggcatacaggtgccgtagatggtcaggataaattcctgtaactcattgcccggcccttcataagtgaacatcacgtattcaccgccttccagcgtcaccggatgggcattttgcaggtgaccgttcgccatttccggcgtcacggcggtggtgtagaacacctcctgctcgtcatccttttcgctgcccggacgcgtttcatgcaggccgtacagttcggctggcaactgcggcgagttgcctaagaattcccgccagaactgaatacgcatgtcgttacggaagcgcgaaatctcctccagcgagcaggtatagctctgggtggtgcccaccaggtccatcgtcggcagcgtaacaaactgatactcgggcatatggaattcgcccagacgcagcggagggcggatgccgtaggcgctccagtccggggcgcggcggtatagtgctggcgtcagattaaattgctttttgaacgcgcgggtgaaggtttgctgcgagtcaaaacggtattgcagggcgatgtccagaatcggacgtgctgttaaacgcagcgccaccgccgccttggataaccggcgtgcgcgaatataggcacctatcgcatgacctgtcacatccttgaacatcctttgcaaatgccacttggaatagcctgctttcgccgccacattatccagagcgagggattgatccagatgcccctccagccagacaagcagttcgcgaataatcccagcctgatccatattgtgtcctcatccttatttagcgggtgcctgatactaaggtagcggataatagcatttttcgttcttttagcattcagtgttttttttgcgcataaatgcttttcatggttgaatttattctgatttttcgtaattcagtgatttatagctattttcttctgtaacggacaataatcactcaacgtaatttttatcaatggtaacaatatgaaatacaagcgtttgctgctgtgcctgttcctgtgcgctgccggacagtcggttcaggctgaacaaattggctctgtagatacggtatttaaaatgtttggcccggatcacaagatcatagtggaagcctttgacgatcccgatgtgaaaaacgtcacctgttatctgagccgcgcaaaaacgggcggtatcaaaggcggtctggggctggcggaagatacctcagacgcggcgatttcctgccagcaggtcgggccgattgagctgagcgaaaaggtgaaaaccggtaaggcgcagggcgatgtggtgttccagaaacgcacctcgctggtgttcaagaaattgcaggtggtgcgtttctacgacgcgaagcgcaacacgctggcttacctgacgtactcggataaagttgtggaaggctcgccgaaaaacgccatcagtgccgtgccgattatgccgtggggtaaatagcaggctgcacggatgccgtggaaacgggtccggatggagaaaagaaaaacggcgcatcatgcgccgtttttattcttattccgctaaatcgccgcagaaacggtaaccttcaccgtggatggtggcgataatttccggcgtgtccggcgttgattcgaaatgcttacgaatgcgacgaatggtcacgtcaacggtacggtcatgcggtttcagctcgcggccggtcatcttcttcagcagatcggcgcgggactggatcttgcccggattttcgcagaagtgcagcatggcgcggaattcgctacgcggcagcttgtactgctcaccgttagggctgatcagcgagcggctgttgatatccagctcccagccgttgaacttgtagctgtcaacggtgcgacgctcttcgctgatcgcgctcagattcatcgtacgggacagcaggttgcgtgcacggatggtcagctcacgcgggttaaacggtttggtgatgtaatcgtcagcgccgatttcgaggccgaggattttatccacttcgttatcacgaccggtcagaaacatcagggcgacgttcgcctgctcgcgcagctcacgtgccagcaacagcccgtttttaccaggcaggttgatgtccatgatcaccagattaatgtcattttcggagaggatctgatgcatctcagcgccatcagtcgcttcaaagacatcgtagccttctgcttcgaaaatgctcttcaacgtgttgcgtgttaccaactcgtcttcaacaataagaatttgcggggtctgcatgtttgctacctaaattgccaactaaatcgaaacaggaagtacaaaagtccctgacctgcctgatacatgtcgcaaattaacatgcacggcgtaacatgactaaagtacgtaattgcgttcttgatgcacttaccatcaacgtcaacaacatcattagcttggtcgtggttactttccctttggacccgacagtgtcaaaaacggctgtcatcctaaccattttaacagcaacataacaggctaagaggtgccagacacccaataaaactacgcttcgttgacatatatcaagttcaattgtagcacgttaacactttgatgaaatattcgtagctttatatgagccgctttcacaatctatcaataaaccaaccagttgcaacagtaaattaataagtgttgtgaatccgaaaagagataagcatttatggcataattagccagcataaacaggagcctgcactgcttctgttaacataaaatcaggtagtcaatctatgcaacagtgtagttctttttaagcataccggacgctgatttcagtgatttctgttgcaaaaatgtaaatttgcatcgcgtaatatcttgacgaaagtggtcttgcagaaggccaggcgtattaaaagagagtcccacatgcaggtatccatcatattagtttcacccgcccgcgcggaaaatgtcggtgcggcggcacgcgccatgaagaccatgggctttactgatttgcgcattgtggacagccgcgcgcatctggaggaaggggcgcggagagtggcgcacggatccggcgatgtgcttgataatgctacggtttatccaacgcttgaagcggccctgcacgatgtgcagtttaccgtcgcgaccaccgcccgcagccggtcaaaattccattactacgccacgcctgccgaactggtgccgctgatgcaggagaaaagccagtggcttcatcacgccgcgctggtgtttggccgtgaagattctggcttgaccaatgacgagctggcgctggcagatgtgttaaccggcgcgcctatggtggccgattatccgtcgctcaatctggggcaggccgtgatggtctattgctatcagttaacaactttaatgcaacaaacggccgccacgcccgacgttatcagtgacgagaaccagttacgcgctctgcgtatacgcgcgcgggcgttactggaaaaactgggtgtcgacgacgacaccaagatggtcgactggctggaacagcgtattggtctttttgagcagcgcgacacggcaatgctgcaccgtttgctgcatgatatcgaaaaaaagctcgccggttaaaagtttgagatattcctttatggcagtcagatcgactgcctgcttgccacactgtggcgaattttcagcaaaatctgcgcacaaacagcgtgagcggcccgccagtggaaaagtcgtaaaattaaaaataaattgacttggcagggcagatactttaaccaatataggcatacaacacagacagataataattacagagcacacaacatccatgaaacgcatcagcaccgtcaccattattacgacaaccaccattacaacaggtaacggggcgggctgacgcgcacaggaaacacaggaaaaagcccgcacctcaacagtgcgggcttttttttcggctaaagatcaaggggtaattccatgcgagtcttgaagttcggcggtacatcagtggcaaatgcagaacgttttctgcgtgttgccgacatcctggaaagcaatgccaggcaggggcaggtcgccaccgtgctgtctgccccggctaaaatcaccaatcacctggtggcgatgattgaaaaaaccatcagcggtcaggatgccgtacctaatatcagcgacgcagagcgcatttttgccgaacttcttcagggtctttccgacctccagccagatttccctctcacccgcctgaaaggcgttgtggatcaggaattcgcccagatcaaacatgtactgcacggcatcagcctgcttggtcagtgcccggacagcatcaatgcctcgatcatctgtcggggtgaaaagctctctatcgccattatggctggattgctggaagcgcgcggtcataaagtgacggttatcgatccggtggaaaaactgctggcggtcggccattaccttgaatccaccgtcgacatcaccgaatccacgcggcgtatcgccgccagccgcattcccgcggatcatatggtgctgatggcgggctttaccgccggtaatgaaaaaggcgagctggtggtgctggggcgcaacggctctgactattccgccgcggtactagccgcctgtttgcgcgccgactgttgtgaaatctggaccgatgtcgacggggtctatacctgcgatccgcgccaggtgccggacgcccgcctgctgaaatccatgtcctatcaggaggcgatggagctgtcatacttcggcgcgaaagtgttacacccgcgcaccattacgccgatcgcccagttccagatcccgtgcctgattaaaaataccggtaatccgcaggcccccggcacgctgattggcgccagttccaatgaagacggactgccggtaaaaggcatctctaacctcaacaatatggcgatgttcagcgtctccggccccggcatgaaaggcatggtcggcatggcggcccgtgtgttcgccaccatgtcccgcgccggtatttcggtagtgctgatcacccagtcctcctccgaatacagcatcagcttctgcgtacctcaggcggactgcgcccgcgcccagcgcgccatgggcgaagagttctatctggagctgaaagaaggcctgctcgaaccgctggcggtcatggagcggctggcgatcatctccgtggttggcgacggcatgcgtaccctgcgcggcatttcggcgaagttctttgctgcgctggcacgggcgaacattaatattgtcgccattgcccagggctcttccgagcgctccatttccgtggtggtcagcaatgacgatgccaccaccggcgtgcgcgtcacgcaccagatgctgtttaacaccgatcaggtgatcgaagtctttgtggtcggcgtcggtggcgtcggcggggcgctgctggagcagctgaagcgtcagcagggctggctcaagagcaagcatatcgatctgcgcgtctgcggcgtggcgaattcaaaagcgctgctcaccaacgtgcacggtctggatctggaaaagtggcaggctgagcttgcggaagcgaaagagccgtttaaccttggccgtttgatccgtctggtgaaagagtaccacctgctgaacccggtgatcgtcgactgtacctcaaaccaggcagtggccgatcagtacgctgatttcctgcgggaaggtttccacgtggtgacgccgaacaaaaaagccaacacctcgtcgatggcctactaccacgagctgcgcaacgccgccagcaaatcgcgtcgtaaattcctctacgacaccaacgtcggcgcgggtctgccggtgattgaaaacctgcaaaacctgcttaacgccggtgatgaactacagcgtttctccggcattctctccgggtcattgtcctttatcttcggtaagctcgatgaaggcgtgtcgctgtcgaaagccacccgcgtcgcccgtgaaatgggctataccgaaccggatccgcgtgacgatctgtcgggtatggacgtggcgcgtaagctgctcatcctggcgcgcgaaaccggacgcgagctggagctgtctgacattgtgatcgaaccggtgctgccggaaagcttcgacgccagcggcgacgtggagagctttatggcccgtctgccggaactggacgatgccttcgccgcccgcgttgcgaaagcgcgggatgccggaaacgtgctgcgctacgtgggcaacattgaagaagacggcgtctgccgggtgaagatcgccgaagtggacggcaacgatccgctgtataaagtgaaaaacggcgaaaatgcgctggctttctacagccactattatcaaccgctgccgctggtgctgcgcggttacggtgcgggtaacgatgtgacggcggcgggcgtgttcgccgatctgctgcgcaccctgtcatggaagttaggagtttaacatggtgaaagtgtatgccccggcctccattggcaacgtgagcgtggggtttgatgttcttggcgcggcggtatcgccggtcaacggcgagctgctgggcgactgcgtcagcgtcgaggcggcgggggaattctcgctgaccaaccaggggcgcttcgtcagcaagctgcctgccgaaccgcgtgaaaacatcgtctatcagtgctgggaacgtttttgccaggagatcggcaaaaccattccggtggcgatgacgctggaaaaaaatatgccgattggctccggcctcggctccagcgcctgctcagtggtggccggcctgatggcgatgaatgaattctgcggcaaaccgctcagcgatgcccgcctgctggcgctgatgggcgagctggaaggccgtatttccggcagtattcactacgataacgtcgcgccctgcttcctgggcggcctgcagctgatgctggaagaaaacggcatcatcagtcaggacgtgccaggctttgaagagtggctgtgggtgatggcctatccgggcattaaagtctccactgccgaagcgcgcgccatcctgcccgcgcagtaccgccgtcaggattgtattgcgcacggtcgctatctggcgggatttatccacgcctgccatacgcagcagcctgcgctggcggcgaaattaatgaaagatgtcatcgctgaaccttatcgcaccaaactcctgcctggctttaacgatgcccgtcaggcggcggcagagatgggggcgctggcctgcgggatctccggatccgggccgacgatgtttgcggtgtgcgataacccggccaccgcgcagcgcgtggcagactggctcagccagcattatctgcaaaacaacgaaggttttgtccatatttgtcggctggatacggctggcgcacgcgtactgggataactaatgaaactctacaatcttaaagatcacaacgagcaggtcagttttgcccaggcaatcacgcaggggttaggtaaaaaccaggggctgtttttcccgcacgatctgccggaattcagcctgaccgacatcgacgccatgctggagatggatttcgtcacccgcagcagcaaaatcctcgccgcctttattggcgatgagatcccggaggagatcctcgaagcccgcgtgcgcgccgccttcgccttcccggcgccggtgagcctggtggaagaggatatcggctgtctggagctgttccacggcccgacgctggcctttaaagacttcggcggccgctttatggcgcagatgctgacgcacatcagcggcgacaagccggtgaccatcctgaccgccacctccggcgacaccggcgcggcagtggcccatgcgttttacggcctcgaaaacgtgcgcgtggtgatcctctacccgcagggcaaaatcagcccgttgcaggaaaaattgttctgcaccctgggcggcaatattgaaaccgtcgccattgacggagatttcgatgcctgtcaggcgctggtaaagcaggcctttgacgatgaagaactgaaaggggcgctggggcttaactccgccaactccattaacatcagccgtctgctggcgcagatctgctattacttcgaagccgtcgcccagttgccgcaggaagcccgtaaccagctggtgatctcggtgccaagcggtaactttggcgatctgaccgccgggctgctggcaaaatccctcggcctgccggtgaagcgttttatcgcggctactaacgccaatgacaccgtcccgcgctttttgcagggcggcgaatggtcgccgaaagcgacgcaggcaacgctgtccaacgccatggacgtgagccagccaaataactggccgcgtgtggaagagctgttccgccgtaaaatctggcgtcttaacgagctgggctatgcggcagtggatgacgaaaccaccaaatccaccatgcgcgagctgaaagagaagggctatctttctgaaccgcatgcggcgatagcctaccgcgcgctgcgcgatcagctgcatccgggggaatacggtctgttcctcggcacggcgcatccggcgaaattcaaagagagcgtggaagcgatcctcggcgaaccgctggaactgccgcaggagctggcggcgcgcgccgatttaccgctgctgtcccataccctgccggcggatttcgcggcgctgcgcaagctgatgatggcaagagcgtaatgtgatgacgttgcccggcggcgcaagcttgccgggcctacatatggttgggctggttatgcccggtggcgctgacgcttaccgggcctacgtatggctggcgcgttgttttgtaggcctggtaagcagagcgccaccgggcaacaagggcattaacggagggcgattactgctcccggcgtttaaagactaactcacctttccctgacatttcttcatcaaacgcatagccatccaccgcaaaatccttcagctgcgccggggtcttcaggcgattttgaataatgtagcggctcatcagcccacgcgcttttttggcgtagaagctgatcaccttgaacttaccgttcttctcatccaggaataccgacttgatgatctcgccgtcgagcagtttcggttttaccgcgcggaaatactcatccgaggcgaggttcacgatcacctgatcgccctgcgccgccagcgcctggttcagtttttgggtgatggtttcgccccagaattgatagagatcgctgccctgcgggttctcaagacgaatgcccatttccaggcgatagggctgcatcagatccagcggacgcagcacgccgtataacccggagagcatacgcagatgctgctgggcaaaatcgaaatcctcctcgctgaaggtttccgcctgtaagccggtatagacatcgcctttaaaggcgaggatcgcctggcgggcattgtccggcgtgaagtccggctgccagtcgtgaaagcgggtggcgttgagatcggcaagcttatcgctgatgcccatcagcgctttgatttgcggcgcggagagcttacgcgcaacgtcaatcagacgctgggaatgatccagtaactccggctgcgtatagcgggttgtcgccagcgggctttggtaatccagcgtttttgccggtgaaatcagaatcagcatatccagtccttgcgggaaattttgggtgactgtagcaaaaaaatcaccctgattgatcgattgttgcgattgccgccgttactcgcgcggcacctcgtcccaggcgccgggcgccagctggcgttcgatttccgggtagcgcttaggatcgaacaccggcctgatacccagcttacgctggcgcagataatcaccggcgataatggttaccaccggcgagagcagcagcagcgccatcaggttgatcagcgccattaacgccatcaccacatcggcgatctgccagaccaccggcagactcaccagcgagcctgccatcaccatcgtcagggtcgtggcgcgcagcagccagacgttccttttgttatgcagccgcaggaatacgaggttgttctcggcgtagagatagttcaccacaatggaagtcagggcgaaaagcagaatgacaaaagcgacaaaacccgctccccagttgccggtcagcgacaccagcgcgtgctgcatcagctgaatgccatcgctggcaggtcgggtggcatattcatccgccagcaggataatcatggcgctggccgtactgaccacaatggtgtcgatcaccacgccaatcatctgcacgataccctgcgccgccgggtgaggcggccaggagactgccgccgcggcgacgttgggcgttgagccaagcccggcctcgttggagagcattccgcgctgaaaaccgctggtgatcgcctggcttaaggtatagcccagcgtcccggcggcggcttcctcccagccaaaggcgcttttcacaatcagcatgatgatgtgcggaagctggtcggcatgccacagcgtaatcagcaggctggcgcccacccacagcaccgccatcaccggcaccacccattgcatcagccgcgccacgccgtgcatcccgcgcagaataaacaacaaactgagcagcgccagcacaaggcccgccatgccgcccggcatcgcaaaagcaaagtgaacggcaccggcaacggcgttcgcctgcatggtgttgaagatcagaccgtaggcgatcaacagcaaaacggaaaacagcacgcccagccagcgcattcccagccctctggcgagataccacgccggaccgccgcgaaactgctggttctggtcgcgctctttatacagctgggagagggagcattcggcaaaggcggtcgccatgccgatcagcgcagaaacccacatccagaacaccgcccccggtccgccagcggtgaccgccagcgccacgccggcaaggttgccgttgccaaaacgggcggcaaggctgacgcataacgcctgaaaggaggagagcccgccgggctgcggcctgacgctggtaataaggctgcgtgcgaagagacggatatagcgaaactggataaaaccgctgcgaaaggtgaaccagatccctgcacccaacagcaggtagatcatcaccgatccccacagtatttcattgatgaataaaaagaaatcaggcattcacattcctcttgttcatgccgttaggccacgcccgcttaccgcgcgcggcgctgtcgaaccgcgagtttatcatactctgcgcttgccaattgactgcggttgcgctgacagagtggcgtgatattatctgggcagaccggttacatccccctaacaagctgtttaaagagaaacactattatgacggataaattgacctcccttcgtcagttcaccaccgtggtggccgacactggagacatcgcggcaatgaagctgtatcagccgcaggatgccacaaccaacccttctctgatccttaacgcagcccagatccctgaataccgcaaactgattgacgacgctgtcacctgggcgaaaagccagagcagcgatcgcgcgcagcagattgttgatgcctcggacaaactggccgtcaatatcggtctggaaattctgaaactgatcccgggccgtatctccaccgaagtggatgcgcgtctgtcctacgataccgaagcgtctatcgccaaagctaagcgcctgatcaaactgtataacgatgcgggcatcagcaacgaccgtatcctgatcaaactggcttccacctggcagggtattcgtgccgctgaacagctggaaaaagaaggcatcaactgtaacctgacgctgctgttctccttcgcgcaggcccgtgcctgtgcagaagcgggcgtgttcctgatttccccgttcgtcggccgtattctcgactggtacaaagcgaataccgataagaaagagtacgctccggctgaagatccgggcgtggtttccgtaacggaaatctacgagtactacaaacagcacggctatgaaaccgtggtcatgggcgcaagcttccgtaacgttggcgaaatcgttgagctggcgggttgcgatcgtctgaccatcgccccggcgctgctgaaagagctggcggaaagcgaaggcaccatcgagcgtaaactctccttcagcggtgaagtgaaagcgcgtccggcacgtatcaccgaatccgagttcctgtggcagcacaaccaggatccgatggcggtagacaaactggcggatggtatccgtaagtttgcggtcgaccaggaaaaactggaaaaaatgatcggcgatctgctgtaatccccgaagcgtggccgggcctccggtcacgcttatccgcttcccccctgtctgtccttttccccgacgtgtattattccgtgatagtgaatgactaaaaacggaatgacgatggatactttacgcattggcttagtgtcaatttcagaccgcgcatcaagcggtgtctatgaagacaaagggttgcccgcgctggaaagctggctgacgcgcgccctcaaaaccccctttacgctggaaacccggctgatccccgatgagcaggccatcatcgagcagacgctgtgcgagctggtggatgagatgagctgtcacctggtgctgaccaccggcggcaccggcccggcgcgtcgtgacgtcacgccggacgccacgctggcggtcgccgatcgtgaaatgcctggctttggcgaacagatgcgccagatcagcctgcactatgtgcccacggcgatcctttcccgccaggtgggggtgatccgtaaacaggcgctgatccttaaccttcccggccagccgaaatccattcaggaaaccctggaaggcgtgaaagccgccgatggcagcccgctggtgcacggtatttttgccagtgtaccgtattgtgtacagctgctggatggtccctatgtggagacacatccggaagtggtagcagcatttcgtcctaaaagcgcaatacgcgaaataaacggccaaaaataagccttttgtgacataacctgagctgcctgtggcgtgctgaattatttacgatatagtaatttttactttacatgctgtatcgaaaataacgtcaattcacctctgcacaatggtcggttatgtcacattacacacgccctctgaatcgtcaggatgtcaaaacgctctccctcgctgcccttggcggggcgctggagttttatgacttcatcatcttcgtcttctttgccgccgttgtcggcgagctgtttttccctgcggatataccggaatggctgcgccaggtgcagaccttcggtattttcgccgccggttacctggcgcgtccgctgggcggcatcatcatggcgcactttggcgatctggtggggcgcaaaaagatgttcaccctgagcatcctgctgatggcgatcccgacgctggcgatgggtctgctgccgacctatgcctccattggtatcgccgcgccgctgttgctgctgctgatgcgcctgttgcagggggcggcgattggcggtgaagtgccgggggcctgggtttttgttgccgagcatgtgccgggcaaccgtatcggtatcgcctgcggcacgctgaccgccgggctgaccgtggggatcctgctgggctcggtggtggcgacgctggttaacaccagcctgacgccacaggcggtgcacgattacggctggcgtattccgttcctgctggggggcgtgtttggtctgattgccatgtatctgcgccgctggttgcaggagacgcccattttcctcgagatgcagcagcgtaaagcgctggcccaggagttgccggtgaaggccgtggtggtcaggcaccggaaagcggtggtggtatccatgctgctgacctggctgctgtcggcggggatcgtggtggtgatcctgatgtcccccgtctggctgcaaaaacagtatggtcttgcgcctgcgctcaccttacaggccaacagtatcgccaccattatgctgtgcatcggctgtctgctggcggggctggcggcggatcgctttggggcgagcaaaacctttattaccggcagcctgctgctggcctgctcaagctggctgttttaccacctggcgggggcgcatccgcaatatctcttcgcgctctatggcctggtggggctgtgcgtcggcgtagtgggggcggtgccttatgtgatggtgcgggctttcccggcggaagtgcgttttaccggcatctccttctcctataacgtctcttacgccatttttggcggcctgacgccgattgccgtcaccatgctgatgggcgtctcgccaatggcgcccgcgtggtacgtgctggcgctgtcgctggtggggttagggctgggcgtctggctgcgccaggatctgtatcatgacgatacggtcgcggagcagccgcttcagcagatgtaaaaaaaatgcagagcctggctctgcatttttgttttacgctcagcgcaggatggtgacgtctgagaacgtgaagcgttttttcttcccgtcttcctgatagccgatgcggataaatacccgcagatcttctatccacgcgtaatcgctgctcatcgctttgccatcgccgcgatcgtcggtgcagctcagttccagataacgtccgctgaaacgcttactgagcgcggaggctgattgccactcctcttctgcccggcacagctggcttttcgttttctctttcccggcgcttttgccgtcggcaagcagggtctgccagcggtattcaccgcccggctgcggcggcaggctgaagctgctgtccagcgtctgcccgaccagcggcgcaggattcatcgaatcccattcccggatgttgacgatattaaacagccgctgatactgcgaataaaaggtcacattgcccagcgtcagcgtatccagcgccagggtggagccatccggcagcacgtcgatgcgggtgacggaggtttcattgacgtcatcggcccagtgctgggtgtaggtcaggcgggtgaaggcgggatgctgatcggggcgggtcatcgcctggctgataccctcagcggcctgtttgcccagcggataacgctggatggggccaggttcgttctgcgggaaatccggcggcgtcagttggttttccgcaggggttttctcccgcgccaccagcgggccgctgccggtaaactcatgcagatcttttacgccgcacagggttttcgccacttttgccagcggcggggcgagcggggtgaatttcgccgcgatgggcgtctggctgtcggtaacaaactgcttatccagcgcaaagtggttaagcgccatgccctcgccggtttcgcagttaagcatcatctcgtcaattttcattgagtaaggcgcggcatacttttcgtcacggtaaatgcgcgcgtaatcggtggcgagccgcactttcagcatccgctcttcacgctgactgttgttcacatccacatacaggcgatcagcctggtcgtcggcggaggatagccctgcccagcgcggttccggcacatttttctggcacacgtccagctcggttttggtggcgaacaggctgtcagcatcaggttcaaagggagtgcccggcgtataacgggaaatggaattcatgctatagacgcgcagagaggggcgggattttgcctgcacgtccataaacagcaacgttttttgctgcgtgcggcagtcgatattcatccacatatcattggcatcgccgctcgccagcgagacgcgaaaaatagcgttaatggtatcgcccatgcgcacggtgctgccgggtagccattcaacattggtgacggcgggagcgggtggcatggggatcgcccgcgccggtgctgtcgctatcagccccagagagagtaaccccaacggaaggggagataaccgcatcatcggcagtccttgttaaaaagaaagagctgatgaaaataccgcatttttgcgcggcaggacaatgacgcggcgcgagggcaaaaaaaatgcagagccaggctctgcattttaataagcagggagattagcgcttttcaccaattggcagcacggtgcggccaaattgttcgttcaggacttcacccatcgccaggtaaatggcgcttgcgccgcagaccaggccaatccagccagcaatatgcacaatgctttcgttgtccgccaggtgaccggcgcacagcagggcaaacagcacggtcaggctcaggaatacgaactgcagcatgcgcgggcctttcagcgtaccgaagaacataaacagggtgaacacgccccagatgcccagatacacgccgaggaaatggccgtcagccgcagccgccagacccattttcggcagcagcagaatggcgaccagcgtcagccagaaagagccgtaagaggtaaaggcggttaaaccaaaggtattgccttttttaaattccagcagacctgcaaaaatctgcgcgataccgccgtagaaaatacccatcgccaggatcacgccatccagcgggaacataccaatattgtgcaggttgagcagaatagtggtcatgccgaagcccattaagcccagcggtgccggattagccaacttagtgtcgcccataagtcctcaaggaaaaaatcatcattaaaatggtgaaagtaaaagcccacgccagggatagaggaggcggggcgcggcatcataatgagcggcggtcacggtgtctatgatctgaacagggtgaaattaaaaaattttttagccgccccccttgatgccttcctttacgaccccatcttgtagtcaaccgaagtgagtggatctgaaaaaaacactcagggggcagttgaaagccattcatttgcccttattacagatccacaaccacatgatgacgaatttttagtggagacgtttagatgggtaaaattattggtatcgacctgggtacaaccaactcttgtgtagcgattatggacggcaccactgcacgtgtgctggagaacgccgagggcgatcgcaccacgccttctatcattgcttatactcaggacggtgaaactctcgttggtcagccggctaaacgtcaggccgtgacaaacccgcaaaataccctttttgcgattaaacgcctgatcggtcgccgcttccaggacgaagaagttcagcgtgacgtgtccatcatgccgtacaaaatcattgctgccgataacggcgatgcctggcttgatgtgaaaggcaccaaaaccgcaccgccgcagatctctgctgaagtgctgaaaaaaatgaagaaaacggcggaagattatctgggcgaaccagtaactgaagcggttatcactgttccggcttactttaacgatgcgcagcgtcaggcgaccaaagacgccggccgtatcgcaggcctggaagtaaaacgtatcatcaacgaaccgaccgctgcggcgctggcttacggcctcgacaaagaagtgggcaaccgtactatcgcggtttatgacctgggcggcggtactttcgatatctccattatcgaaatcgacgaagttgacggcgaaaaaaccttcgaagttctggcaaccaacggtgatactcacctcggtggtgaagactttgacagccgtatgatcaactacctcgttgaagaatttaagaaagaccagggcatcgacctgcgcaatgacccgctggctatgcagcgtctgaaagaagcggcagaaaaagcgaaaatcgagctgtcttccgcacagcagaccgacgtgaatctgccgtacatcaccgcagacgccaccggtccgaaacacatgaacatcaaagtgactcgcgcgaaactggaaagcctggtcgaagacctggtaaaccgttccatcgagccgctgaaagtggcgctgcaggacgctggcctgtctgtttctgacatcaacgacgttattctggtcggtggtcagacgcgtatgccaatggttcagaagaaagtggctgagttcttcggcaaagagccgcgtaaagacgttaacccggacgaagcagtggcaatcggtgccgcggttcagggcggcgtgctgaccggtgaagtgaaagacgttctgctgctggacgttaccccgctgtcgctgggtatcgaaaccatgggcggcgtgatgactccgctgatcagcaagaacaccactatcccgaccaagcacagccaggtgttctcgacggcggaagataaccagtctgcggtaactatccacgtgattcagggtgagcgtaaacgcgcttctgataacaaatcactgggtcagttcaacctcgacggtatcaacccggcgccgcgcggtatgccgcagatcgaagtgaccttcgacatcgatgccgacggtatcctgcacgtttccgcgaaagacaaaaacagcggcaaagagcagaaaatcaccatcaaggcgtcttctggtctgaacgaagaagaaatccagaaaatggtgcgcgatgctgaagcgaacgcggaatctgaccgtaagttcgaagagctggtacagacccgcaaccagggcgaccatctgctgcacagcacccgtaagcaggttgaagaagcaggcgatcagctgccggctgacgacaaaaccgctatcgagtctgcgctgagcgcgctggaaacttctctgaaaggcgaagataaagccgacatcgaagcgaaaatgcaggcgctggcccaggcttctcagaagctgatggaaatcgctcagcagcagcatgcacagcagcaggcgggcggtgctgacgcttctgcgaaccatggcaaagatgacgacgttgtcgacgctgagttcgaagaagttaaagacaaaaaataatcgccctttgaacgggtaaatactggcacgggcgaagaggtttcctctccgcccgtgcacgcatgtgaggggcagaaaaaaaagatggcaaagcaagattattacgagattttaggcgtttccaaatcagcggaagagcgtgaaatcaaaaaggcgtacaaacgcctggccatgaaatttcacccggaccgcaaccagggcgataaagaggccgaagccaaattcaaagaaattaaagaagcctacgaagtcctcactgatgcccagaaacgtgccgcttacgaccagtacggccatgctgcgtttgaacagggcggcatgggtggcggcggtggttttggcggcggcggagccgacttcagcgatattttcggcgacgtgtttggcgatattttcggtggtggtcgcgggcgtcaacgggcgtcgcgtggggctgacttacgttacaacatggagctgacgctcgaagaagccgtgcgtggcgttaccaaagagatccgcattccgacgctggaagagtgtgacgtttgccacggcagcggcgcgaaagtggggacgcaaccgcagacctgtccgacttgtcatggttccggtcaggtacaaatgcgccagggcttctttgccgtgcagcaggcgtgtccgcactgtcagggccgcggttcgatcattaaagatccgtgcaacaaatgtcacggtcatggccgcgtagagaagagcaaaaccctgtcggttaaaatcccggcgggtgttgataccggcgaccgtatccgtttgtccggcgaaggtgaagcaggggagcacggcgcaccggcaggggatctgtacgttcaggtgcaggtgaaacagcacccgatcttcgaacgtgaaggcaataacctgtactgcgaagtgccgatcaactttgcgatggcagcgcttggcggcgaaatcgaagtgccgacgctggatggccgcgtgaagctgaaagtgcctcatgaaacgcagaccggtaaactgttccgtatgcgcggcaagggcgtgaaatccgtgcgcggcggcgcgcagggcgacctgttatgccgcgtggtggtggaaaccccggtgggcctgaacgagaagcagaaacagctgctgaaagatctgcaggacagctttggtgggccgacgggcgaacacaacagcccgcgctccaaaagcttcttcgacggcgtgaaaaagttctttgacgatctgacccgttaatccgaagacggctgtctttgcacaaaaccgataccttttaccgggtatcggtttttttattgcttcaatactcgggaaaactgagttattagtcagtgataatctgcttttatcgaaccttcattctctttaagatggccccacatgtgcttcgttgtcggagagaaaagaataatgaaggtcttacatcgttttattaacagcgacgcctctggtggcgttacgctgatcgttgctgccctgctggcgatgattatggcgaacctcgacgcgaccagcggcctgtatcgtgattttctcagcatcccggtggagttaaccgttggatcccttgagatccataaagatatgctgctgtggatcaatgacgccctgatggccgtcttcttcctggccattggcctggaagtgaaaagcgaactggtgcagggatcgctggcgacgcgccagcaggccgcttttccggtcatcgccgctttaggcggtatggtccttccagcgcttatctacctgctgtttaacgttcacgatcccattgcccgtcacggctgggcgatccctaccgccaccgatattgcctttgccctgggcgtgctggcgttactggggaaccgcattccggtggcgctgaagattttcctgatggcgctggcgattatcgatgacctgggcgcgatcctgatcatcgcactgttctacaccagccagctgtcgatgctgtcgctgggcgtggcggccgcggcgatagtggtgctggcgctgctcaatgccctgaacgtgcggcggacggggatttatattctcgtgggactggtgctgtggacggcggtgctgaagtccggcgtgcacgcgactatcgccggggtgatcatcggcttctttatcccgctgaaggaaaaagacggcgtctcaccggcaaaaaatctggagcacgtgctgagcccctgggtgagctggctgatcctgccgctgtttgcctttgccaatgcgggcgtttcgcttcaggggatcacgccgaccagcctggcctccatgctgccgctgggtattattgccggtctgtttatcggtaagccgctcggtattaccctctttacctggcttgcgctgcgcctgaagctggcgaaactgccgcacggcacggcgttcaaccagattatggccgtgggcgtgctgtgcgggattggcttcaccatgtctatctttatcaccacgctggcctttgccgagctggagccggagctggtgggtctggcgaagctggggatcctgctcgggtcgttggtctccgccgtggtgggctacgtcctgctgcgctcgcggttaaagcccgtataactgacaaatgcaggctgccctgagcagcctgcgctgtcacgggcaggagaaggttatggcgcatattaactacaaccatctgtactacttctggcaggtctatcagcagggttcggtggtcggggcggccgaggtgctgcacctgacaccgcagaccatcaccggccagatcaaggcgctggaagatcgtttacagggcaagctgtttaagcgtaaaggccgtggccttgaacccagcgagctgggggaactggttttccgctacgccgataagatgttcaccctcagccaggaaatgcttgatatcgttaactaccgtaaagagtctaacctgctgtttgatgtgggcgtggcggatgcgctgtcgaaacggctggtcagcggcgtactggacgcggcggtggtggaagatgagcaaattcatctgcgctgttttgaatccacccatgaaatgctgctggagcagctcagccagcacaagctggatatgatcatctcggactgcccgatcgattccacgcaggaagcggggctgttctcggtgaagattggcgagtgcggcgtcagcttctggtgtcttaacccgccgcctgccaggccttttccaggctgccttgaagaacgccggttattaattcccggccgtcgctcgatgctcgggcgtaagctgctcaactggtttagttctcaggggctggaggtggaaatcctgggggagtttgatgatgcggcgctgatgaaagcctttggcgcggcgcataacgctatttttgtcgccccgacgctttacgcccaggacttctatgccgacgagcgcatgattgagatagggcgggtggagaacatcatggaggagtatcacgcgatttttgccgagcgcatgatccagcatcctgccgtgcagcgtatctgtaaccgggactactcgacgctctttactttaccgcagacgtaaaaaaacccgcctgagcgggtttcttcaacaaagtacaacaagcgggcgattaagccagtttgttgatctgcgcggtcaggttagccttatgacgcgctgctttgtttttgtggatcagacctttagcggcctgacgatccacgatcggttgcatttcgttaaatgctttctgcgcagctgctttgtcgccagcttcaatcgctgcgtatactttcttgatgaaagtacgcatcatagagcgacggcttgcgttgtgcttgcgtgccttttcagactgaacggcgcgcttcttagctgatttgatattagccaaggtccaactcccaaatatgatctatgtggacaattcaaaggccgaggaatatgccctcttagccttcttttgtcaatggatttgtgcaaataagcgccgctgcgtagcgacactcgttacgtgtgatggcgcaggattctaccagcaagccgcgcgtagatacagcttttccgccataaaaatcacaggcaaggggcagttttttcgcaggcctgacataagcacaatgaaatcaacacagctttctgtttacgaaggccaatcgccggttaaccttgaacgctgtacaaggtatactctgccgatttccccgtttttgagccagacatgaagctgatacgcggcatacataatctcagccaggccccgcgcgggtgtgtgctgactattggtaatttcgacggcgtgcatcgtggtcatcaggccctgatcgaggggctgcgtgaagaaggccgcgcacgtggtttaccggttgtggtgatgatttttgagccgcagccgctggagctgttcgcgggcgataaagcgcccgcccgcctgacgcgcctgcgtgacaagctgcgttatctggccgaatgcggcgtggattacgtgctgtgcgtgcgcttcgacaggcgctttgccgcgctgacggcgcaaaacttcgtcagtgatttgctggtcgaccgcctcggcgtgcagttcctcgccgtgggggatgatttccgctatggcgctggtcgtcagggcgatttcttgttattacagaaggccgggctggagtatggttttgacgtcaccagcacgcaaaccttctgtcaggatggtgtacgcgtcagcagcacggcggtgcgtcaggcgctggcgaacgatgacatcgcgctggcggaaagcctgttaggccatccttttacaatttccgggcgcgtggtgcatggcgatgcgctgggccgcaccatcggcttcccgacggcgaatatcccgctgcgccgccaggtctccccggttaaaggggtatatgccgttgaagtaacggggttgggcgataaacccctgccgggcgtggccaatatcggtacgcgccccacggtggcgggcgtgcgccaacaactggaagtgcatctgttagacgttgtaatggacctctacggacgccatatagatgtcatactgcggaaaaaaattcgcagtgagcagcgatttgcctcgctggatgaactcaaagcgcaaattgcgcgagatgaattaaccgcccgcgagtttttagggctacaaaacccggcgtaacgccaacatacgttttaaatacggaactgagaatctgatgagtgactataaatctaccctgaatttgccggaaacagggttcccgatgcgtggcgatctcgccaaacgcgagccgggaatgctggcgcgctggaccgatgatgatctgtacggcatcatccgtgcggcgaaaaaaggcaaaaaaaccttcattctgcatgatggccctccctatgcgaatggcagcattcatattggtcactcggttaacaagattctgaaagacattatcgtgaagtccaaaggactcgcgggctatgattcgccttatgttccgggctgggactgccacggtctgccgatcgagctgaaagtggagcaggaattcggtaagccgggcgagaagttcaccgccgcagaattccgcgccaagtgccgcgaatacgccgcaagccaggttaacggtcagcgtgaagactttatccgtctgggcgtgctgggcgactggtcgcacccgtacctgaccatggacttcaaaaccgaagccaacatcatccgcgcgctgggtaaaatcatcggtaacggccacctgttaaaaggcgcaaaaccggtacactggtgcgttgactgccgctctgcgctggcagaagcggaagtggagtattacgacaaaacttctccgtccattgacgtggccttccaggctgtcgatcaggacgcggtaaaagccaaattcggcctgccaggcgtagctggcccgatctcgctggtgatctggaccaccaccccgtggacgctgcctgctaaccgcgcgatctccctgtcgccggagtttgattacgcgctggtgcagattgacggccaggcgctgatcctcgccaaagatctggtcgagagcgtgatgaaacgcatcggcgtggccgattacagcgtactgggcaccgtgaacggcgcagaacttgagcagctgcgttttgcccatccgtttatgggctttgacgtgccggctattcttggcgatcacgtcaccctcgatgcgggtaccggcgcggtacataccgctggcggccacggtcctgacgactacaccatcagccagaaatacggtctggaaatcgccaacccggttggcccggacggcacctatctggcgggcacttacccgacgctggacggcctgaacgttttcaaagccaacgacaccatcgttgagctgctgcgtgaaaaaggcgcgctgctgcacgtcgaaaaaatgcagcacagctatccgtgctgctggcgtcataaaacgccgatcatcttccgtgccaccccgcagtggtttatcagcatggatcaaaaaggcctgcgcacgcagtcgctgtctgagatcaaaggcgtgcagtggatcccggactggggccaggcgcgtatcgaatccatggtcgcaaaccgtcctgactggtgtatctcccgccagcgtacctggggcgtgccgatgtcgctgttcgtgcataaagataccgaagagctgcacccgcgcaccctggaactgatggaagaagtggcgaaacgtgttgaagttgacggcatccaggcctggtgggatctcgatgcgaaagagatcatgggcgatgacgctgacaactacgtgaaagtgccggatacgctggacgtgtggttcgattccggatccacgcactcctccgttgtggatgtgcgtccggagtttgccggtcacgcggcggatatgtatctggaaggctccgaccagcatcgcggctggttcatgtcctctctgatgatctccaccgccatgaaaggcaaagcgccgtatcgccaggtactgacccacggtttcaccgttgatggtcagggccgtaagatgtccaaatctatcggcaatactgtcagcccgcaggatgtgatgaacaaactcggcgcggatattctgcgtctgtgggtggcgtctaccgattacaccggcgaaatggcggtgtctgacgagatcctcaaacgcgctgccgacagctatcgtcgtatccgtaacaccgcgcgcttcctgctggcgaacctgaacgggttcaatccggccaccgacatggtgaaaccggaagagatggtggtgctggatcgctgggcggtaggctgcgcgcaggcggcgcaggacgatattgttaaagcgtatgagtcttacgatttccacgaagtggtacagcgcctgatgcgcttctgctccgttgaaatgggctcgttctacctcgacatcatcaaagatcgccagtacaccgcgaaagcggacagtgtggcccgtcgcagctgccagaccgcgctgtaccacattgccgaagcgctggtgcgctggatggcgccgatcatgtccttcaccgccgatgaaatctggggctacctgccgggcgatcgcgaaaaatacgtcttcaccggcgaatggtaccagggcctgtttggtctggcggaaaccgaagccatgaacgacgcgttctggagcgagctgctgaaagtgcgcggcgaagtgaacaaggtgatcgagcaggcgcgtgctgataaaaaagtcggcggttcgctggaagcggcagtcaccctgtacgcagaacctgaactggcggctaaactgacggcgctgggcgatgaattacgatttgtcctgttgacctccggggccgcggttgccgattatgcaaccgcgtccgacgacgcccaacagagcgaactgctcaagggactgaaagtgtcgctcagcaaagccgaaggcgaaaaatgcccgcgttgctggcattacacgaccgacgtcggcaaggtggcggaacacgcagatatctgcggacgctgtgtcagcaacatcgccggtgacggcgaaaaacgtaagttcgcctgatgagtaaaccgatcttttcaacagggctgcgctggttgtggctggtagtggtcgtgctgattatcgatttgggcagtaaattcctgatcctccagaactttgctctgggggatacggtatcgctgttcccgtcgcttaatctgcattatgcgcgtaactatggcgcggcgttcagtttcctcgccgacagcggcggctggcagcgctggttctttgccggtatcgcccttggcatttgcgtgatcctcatggtcatgatgtatcgcgcaaaggcgtcacagaagctgaacaacatcgcctatgcgctgatcattggcggcgcgctgggtaatctgttcgaccgtttgtggcacggttttgtggtcgacatgatcgatttctacgtcggcaactggcatttcgcgacctttaatctggccgatacggccatttgcattggcgcggcgctgatcgtgctggaaggatttttgccttcccgcgcgaaaaaactcgcataaccaatcgccgggcggcgctacgcttgcaccggcctacgatccctgtaggcccggtaagcgaagcgccaccgggcaacaaaatttaaatagagcaacctgcatgtctgaatcgatacagagcaacagcgcagtactggtgcacttcaccttaaagcttgaagatggctccactgcggaatccacccgtaacaacggcaaacccgcgctgtttcgtctgggcgacgggtcgctctccgaagggctggaacagcatctgctggggctgaaagcgggcgataaaaaagccttctcgctggagccggatgcggctttcggggtcgtcagccccgatctgatccagtatttctcccgtcgtgagtttatggacgcgggcgagccggaaatcggcgcaatcatgttatttaccgcaatggatggcagcgaaatgcccggcgtgatccgcgaaattaacggcgaatccattaccgttgatttcaaccatccgctggcgaaccagaccgtccattttgatattgaagtgctggaagtcgatccggtactggaggcataacatgcagatcctgttggctaacccgcgcggtttctgcgctggcgtagaccgcgctatcagcattgttgaaaacgcgctggcgatttacggcgcgccgatttatgtgcgtcatgaagtggtgcataaccgttacgtggtggacagcctgcgcgagcgcggggcgatttttatcgagcagatcagcgaagtgccggacggcgcgatcctgattttctcggcgcacggcgtttcgcaggcggtacgtaacgaagcgaaaagccgcgatctgaccgtctttgacgccacctgcccgctggtcactaaagtgcatatggaagtggcgcgcgccagccgccgcggcgaagagtccattctgattggtcacgcgggccatccggaagtggaaggcaccatgggccagtacagcaacccgaaaggcggcatgtacctggtggaatccccggacgacgtcttcacgctgaacgtcaaagacgaaagcaaactgtcgtttatgacccagaccacgctctcggtggacgatacctctgaggtgatcgacgccctgcgcgtgcgtttcccgaaaatcgtcgggccgcgcaaagacgatatctgttacgccaccactaaccggcaggaagcggtgcgcgccctggcggagcaggcggacgtggtgctggtggtggggtcgaaaaactcctccaactccaaccgtctggcagagctggcacagcgcatgggtaaagcggcgtacctcattgacgatgccgacgacattcaggaggcctgggtcgccagcgccgcctgtgtgggcgtcaccgcaggcgcttccgcgccggatattctggtgcagaacgtcatcaaacgcttacaggcgctgggcggcggcgaagccattccgctggaaggccgtgaagagaatatcgtttttgaagtgccgaaagagctgcgggtcgacgtgaaagaagttcactaacgcagaggttacgcataaaacgccaatgccagccggtgaaaacccgctggcatttttatttaacgcccctgtgatccctgcatcaaaatgcgcagccttcacattaagttaatcgattaacctgttactgttattgggttgttctcctcgggccggagataaccatgaaaccttctttagctctgccgccgcaggtggcatgggccagcggcgcattagccaatggctcgcgcatccgtaaatcgacctgccttcaccagctggagggcgtattcgccgatacgctcgccttccatcaatgcgatccacaccagtgcgtctatgacgtggagatgtttgactccccgaccgccgacggggcgctttacgttggcgtcactcacctctaccccggcaaagtaggcgatgaatacttcatgacgcggggtcattttcaccagcgccgcgagcagggcgaagtctatttcgggctgcgcggcagcggcttactactgctgcaaaatgaacagggggaggcgcggctggagaaggtcatgcctggatccgtacacatcattcccggttttaccgcccatcgtctgatcaataccggcaacgaaaccctctcggcgctggcggtctggccgtgcagcgccggacacgattacgccgcgctcagcagcggttttgcgctgcgcatcaccgaagaaagcgaggtgcgccatggctgagcaaccttttgattgcggtctggatatgactgtccatcgtcagccgctggggttcagctatggcggagaggtcatcggcccgctggcggagatccgcacgctcgatcagatccgcgcttcgctgcgcgatccatactgtcgcggcccgaatgaggtgtacgccattgcgatggatgtggcgcgcattcaggatcgcgacgagctgaaaaaacgcatgctgctgttcggcgtggtaacctatgccgccgggcaactgggcgacgagccggtacgcagccaggggcacgtacaccgcatcagccagcacagcggctggtcgccgccggagctgtacgagatctggcagggcagggcgattatctatatgcaggagtatgtggctgacgatccggggcgctgcttcgcggtgatcgccggtcccggcgaaaaagtgctggtgccgccaggctggggacacgccaccatctccgccagcccggatgaacccttaaccttcggcgcatggtgcgatcgggaatacggcttcgagtacgacgccgtgcgggcgcacaaagggctggcgtggtatccgctgttacaggaaaaacagattatctggcagcataatccgcactacgcgccggggcgcttacaggcgatcaccccccgacgctacagcgaattcggcattactgccgcgccgctctatcagcagtttattgacgatccggcgcgcttccagtttatctcccgccccgataaagccgcagatcggtggctggattttcatccttgataaaaccccggccgggtgagctggcgtcacccggcaaaccttatcccgcgaataccccgctcacgacgcctgcggcggcaagcgccagcaacagcagcatcgctttgaccggcgacacgccgcgtttcgccatcaggtaccaggtgccgagcaccacgacgagcggcaaaagttgcgggaaaataccgtccagcatctgctgcacatgaatattcaccccgtccttagtgataaactcaagcccggtgccgagcttaacgtagcttgccgccacgccgcccatcacgaagacacccagcagcgacagcgcttcccgcaggcgggtagatttactgctcaccagcatctccaccgagccggatcccattttgtagcctttcagaaacaggaaccatgaaccgggaatgatgatcgccagccaggcgacggcataaaacagcggcccgagggcgctgccgcccgccgccagcgccatgccgatactgagcaggatcgggatcagcatcccggggatcatcgaatcgccaatgcccgccaccggccccatcagacccaccttcagcgtgttgatcatgtcaccgtcaatgggttcgccgttagcttttttctcctccagccccagcaccatgccgttcacaatggctcctagctgcggctcggtgttataaaaagacgcatgacggcgcagcatttcctggcgttcggcggcatccggataaagctttttcgccaccggcagcatactcaggcagaagccgaaggattccagacgctcaaaactcatggatgacagattgtgcatcatccacgcccgccagcagcggcgcagatcggttcgggtaagggtgcgattgtccatcagaattcatcctcatcatcgaccggcgcggtcgccacaggctgcgcgggttccggtttgtagttgtagtggatcagcgccagcagcgcgccgacgatcaccagcgcgaccatattgagttttaaaaagacgatgcagacgaagccgaccagaaagtagatcagcatgctgtagtttttgatgatctgcttaagcagaatggcgatccccaccgcaggcagaatgccgcccagcacgttcatgctggaaagcaccactttcggcaggctgtccataaaggcgctgatgtactgcgcaccgaagtagacggcaataaaagtcggcacgaagcgtaaaacaaagttggtcgcctgcggccagatggcgctgttaagccacagaccacgctcgtcgccgcgctccagcgccacatccgcccggtgattccagaacgaattcagcaccatcatggcgttaaacaaaatggttccggcgatgccgatggtcgccgccagcgccaccgccacttccggcccctgcccggaaagaatgccgagcgcaatcgccggataagccacaaaattcagatcggcgggcatcgagccgcccggcgtcaccatggcgatatataccgcctgcaccgccacgccgatgataatcccggttttcatgtcccccaggatcagccccaccagcatcccggataccagcggccgggtgatcagataccagccgccggttaagcccagcagccaggggctgctcagcgcgcccaggtagcacagcaggccaatcagtatcgcgtcgataaacatacaacccccttatttcagtttctgccgcgcgtcctgccagcggtagctgttggcatccggcaccagacgaaactcaatcagatgcccgtgcgcggccagccagtcaaaggcggcaatctcttcggcgttaaccgactggtttgggccgatggtagtggtatccgcgcgggcgctcatcggcccgacgttgattttgccgttggcgttttgcaggttgatcccggcctgcgccaggcgttgcagcgtgaccggcgatttaccgatcacgaaatactgcttttcactggcgatgaccttcggcagtttttcaatcgccgtggcggtatcgaacagccacaccttgatgtcctgaaccgcgcctttcatcaccgacgaaagcagcggatcggccgcgacggcatcatcaatggcgataatgccatcgcagggcagctctttggcccagcgcgtgacgagctgcccgtgaatgacgcgatcgtcaatacgcacaaaagaaagactcatagcaggctcctttaaaaatcatcggatggttcatcagtaacagggacggctttgacgagcgtcggcaacgtcagcgccagcaatcgatccgccgcacggtggacatcggtaaaatcgccgatctcatcgctttgcagcagcatgggaaaattcaccccggccagtaccgccaccggcggcgtggtctgcggggagaaggcatactggcaggcgacattccacggcgtgccgctttgcagatcgcacagcaccagcacgccgtcggcgttctcacttgcgcgggccagctcgcgggcgaaatcacgcttaaagccgtcaatacccgcctgctcgctgagcgtaacgctggaaacctgaggcagctcgccgtacaccatacggctgctgataagcagcgcctccgccagcggaccgtgcgtggcaataatcacgttgatcatctttacccccttacccaggctttgagcgtggcgcattgttgcccgtcgccgcagggcgaaatgcggtactcgcccacggcggcgggaataatgaaggtttcggcataatgcaccacgaagggcgcaaaggccccgtccgggctgtcaaccagcgcttctgtgccctccaccagattgagcacgttaacgccgccctctgtgtgatgcatgaccggcgcggtaaaccagtggcggcgggtttcgataaattcccgttcatgcagcccggtacgctcttcgcgccagctttcgccttcggcgaccgtctcaatgcggtttaccagattgtcgtgcacccacgcggtatcgcgctgccagtcaatcacctgtgcgccgtgatggagatgcaccgggcgcggcaggccgtccatccccacgcgatcccagtcccatagcttgaaggtgaaaatgtagggcgtggcgctgacctccagtaccatggttcccgcgccggagcagtgcaccgtgcccgccgggatcaggaagtgatcgtgcttgcgcgccgggatctgattcacaaagcggccgtcgtcaaagcgcttttctccccggctggcggcgtgcagatcctccagcatcgcctgcggatcgatgccggttttggtgccgagatacaccaccgcctccggcgtcgcgtccagaatgtagtaactctcatcctgggtgtaatgcataccaaactgctgttgaatgtattccgtcagcggatgcacctgcaggctcagattctggccgccgatggtgtcgagaaaatcaaaacggatcgggaactccgcgccaaaacgggcgtggactttctcacctaacagcgcgcggggttgcagcagcaccagatcctgagcggggatctcgatccgcacatcgccaaaccgtagcaacaggctgttttcctcgggcacgcagtcaaaacaccaggcatagtttggttttgtgggatcgagatcgaattgctgtttcatccactggccgccccacacgccagggtcgaaaaagggcatcacgcgaaacggttgttgcacggtttgcgccagcccggcgcgaagcgcctcgccgctgatgagcgcaggcgtatcgccagcggtagtgtcgagcagataatcggcacgtttgagcagcggcgttttgtggcggtcaaacacccgccattcgataaaaaaggcgcgcttgtagcggcgcagaatatcctcatcggcgttatccacgccccagttactcagttcgccgctgcgcatccgctgctgaatttcccagcgcggcagatcggcgtacaccagcacatcgcccggatgcaccagcgccgcgcccgggccatagatcaccgtcagcccgtcgctggcctcgctcacctgctggcgcagcgcccggagtttgtcctcatcaaagaactccacaagctggtggcaggagagcacgccgaacacccggtcgtccgtaagatggcgcgccagcagatgatgcaggtcctgcgcatcccggcgggcgtgctcaacgttaatcacccgcgtggccccgagcgcgggcagcatcctttcttccagctcgcgcaatcgcacgccgggatagcaatcgatcaccagcacgctgcccggctgagcgcgtgcgttcagcacttcggcgattgaattccagccggaccacgcctggtggtcatagccgtgcacgtacacttccggggacttctcataggttgagccagtcattgcagatctcctgtaacaattgccagcgtcaggtaatcgccgggggcgattagcgcgtcatcgcgcagtgccgtgcgccgggcttcgtttaacgacaactgataaatccggctgcccggtgggacgataagcggacagcgttccggctgcggcatggggttaaacagccgcaccaggatttcaccgtcgcgcgtaccggggcggcacatgctgaggaacaagcgcggattgccgcaggcgattagctgtgactctggcggcaggccgtacggggcaatgggcagcgtgaagcgctccaggcgctcctcaaaggtattaagtttttgcacctgataggtgaggtaatgctcgcggtaatccctgcaggcgctgaaaatcgccgccgcatcctgcgggccatccagcagcagcgcatagtcgaatgccatttcctgcaacatctgcgcgtccggcgtttcgacgactttgttattgatgccggacgcccggccaggccgccacagggtatcgtctttaccgagcaggccaacgctgcggaacagcgtcagcgccagggtatcgctccccggcagcacctcgtactctttgatgcctttggttatcacgccgaaacagtgctgttcatcctgcagataaaccacgttttccagcgtgtagatgggcatcggtttttccacaaagcccagctcgcgccactgtgcaacgtaagggttcaccgtctcgcggcgaataatactgaagccctgatcggcaaaggaatagttgggctgttccaccggcgttttcaggtgtacccgcaggcggtgctcggtggcggcgttgatcagctgatgatgcacgcgcacaaaaccttcgccgtcgcgcagctcaagcgtagtggcgatggccattttctggcgggcgatccctgtctgccgttccgccatattcgcgggcagcatgagggaggatcgcagcgtcaggcgcgacacctgcgcgctgctttcacaggtcacaacgtggaattcccggcaggtgagcggctgctcgtccgccagcggcgcgaagtcgaattcatcgccgtcatcaccgcaatcgacaaaggttaagaaatcttccacgcgctggccggtctgtttgttctccagcgtcagcacgccggaggcgaggctgatacggtagcgggcgttttcaattaccggcaggtcgcgccgcaccagacgggcacaggattgctgctcctccacccgtaacgtctgatagccgaggcccggcagcgacggcgggcgaaagaggatctcactgcggtagtagtcggccaccggttcgagtttttcgcccgcggcggtgacgatcaccacctggccgccggagagtttttgctgttgcagcagggtgctctccaccgccacgccgttctgcgtcagggtaaaatcgggttgttgggtgaagatcaccgcgcgggcaagcggggacagcggactgatgtcgcagttaaacaccaccagcagacgctcatccgcctgctggcgggcgatctgatagctgattttcttcttcagcacgttaagcaggctcagcgccgagcgctcgacgctgatcaaccggtttttaatgttctgattcaccgcatcggcgttggtggcctcaatgccattgtgcgcgtgtgcggcgaacagcgttttccacatgctgtcgataaccggctgcgggtacgtcacgccgaggtgcgaggcaaccgccatcagcggctccagctgatcgagcagaagatgctccgtctgccaggtctggcgtttgatgtcgtagcgcgtggagtggcaggtacggtggatacgcgatttctgacaggccaccagttcaccgtcaataacgttactgaacggcgcgcccgcccaggcgtcacgcagataactttcgtaatcggtcatatgaaagtgatagggcgtgtccagttcattcagcgccttcaccgtctgtgggaactgcgcgttcgccagcacctgatcgccaccggctggcagcagcagtttgtcggtgctgcggttaagatcggttaaacggtcgaggatcggcagcagccggtgctctacataatccgcctcggtggataaaaatttccccggcccgtagccgaaatagaggcaacaggcaggcaatgttttctgattcggcgcgcgccagaggaaattcagatcgccgttaagctgatcggtatacacgccgcgctgcaataccgcgtagtcgatccccagatcgccgaaaatcgccgataaatacgcatgctggccgaaaatatccggcagatagccgacgttcatactgtgaccaaagcgctgcgccgtggcgatgccgtactgcaaattgcggatcagggattcggtgcggatcagcagggaatcacactgcgtataccaggggccgacgaacagccgccgctggctgatgagcgcctccagccgcggggcgttttccgggcgcacctgtaaatattcgtccagcaccaccgccagcccgtcaaaggtgaaggaggggaatgttggatcgcgctccagcaggtcgatcagataatccatattctctatcagcagaatatgggagtcctcgcaggtgaaataccactccgcatcccagtggcagtgcgccaccacataaacctcttttttcatcgttttatctcagctgttcaatatgcattttgccggcgcggatcagcgcgtagcgcacgaagacgttggccagggcgataaagctaatgcccgccgccatgccgcacaggtaggcgggcaggttctgcaccagcggccagccccagatggcgggcagcggataccactgcaccgatcccagggtgatggccgtcagcgcgccgatcaccgcgccggtgatattgatggaaatggtgatcagcggatttttcagcatgaaggggatcgccccttcgccgatggcaaggaaacccaggatcaatgaggtggtgccggtgatgcgctggttttcatcaaacacgcgctggcgaacgatcatgcggtcgatcagcgtcgccagcccgatgccgatgggcgggatcacgatccccagcacacgggcggtaaggggatagatatggtcggcggcaaggccgatggcgatcgctccggcggatttgttgaccggcccgccgagatcaaaggcggtgagggaggcgatgatcgccgccagcatcaatgtgctgccgctgccgtgcgccacgatcatctgctgcaaccactggttaatgccgccaaataccggatcgacaaagctgtagttgataaagaaaatcgccagcgcagagaggccgggcacgatcagcatgggcttcatcgcctgtaaatgtttgtgcaggcggatatgggtattcagatagtccgcaaggaaaccggcgatcatgccgaggatcagcgcgccgagaaagcccgacggaatgccgccgctcaccgaccagaaagtgtaatgcaggccaccggcaaaggcgccgccgataaaacccggcaccagaccggggcggtcggcgatgctgtaggccatgtacgcggcgaagaccggatacataaacttcatgatcatgttgccgtattgcgtcaggaaatggcagagcaccagcgcggtgctatcgctctttgcatagctggcgctgccgatatccgtcacccccagcaggctggcggttaactggccgacgccgatcatcagccctgcggcgacgatcaccgggatcatgtatgaaataccgctggatattccctgatacagacgggcgagaaaggatttctcccgcgtgcgcgactcgctgctgtcgccgtcagcgctgacaatgccgtccggctggcgcagcagacggtcgatcaggccgtccgcgtctttcagcggttctgacactgaagtggcgatatagggcttgccgttaaaacgcgctttgccttttggcggcagggtggcggcgaaaatcactccggcggcagcggcgatctgcgcgtccgtgacttcatcctcggtaccgttggcaccctgtttttcgctccacacctgaatgccccgcgccgcgcccgctttttccagcgcttccgccgccatataggtatgtgcgatgcccgccgggcaggaggtgataacaatcaggctttgcccgccggcagtcaccggcgtgctggcgcgggaagcgttggtgtcatccagcagcgtaagaaaatcctccactgtggccgccgctttcagcgccgccacccgctgctcatccatcagcgacaggctgagggtggagagcaggcgcagatgtccggcgtcatcgccgaagggcaccgccagcaaaaagatcagctccacctgatcttcaccgtccatggtgggccagtcgcgcaccggctgcgtaacgcgcgccaccgcaaaggcggggcgggcgaccacggcagatttgccgtgaggaatggcaacgccctgttcaaagccggtttccgacagcgtctcccgctgccagaccgcctccagaaacgccgccttatcgctgactttgccttcgtcatacaggcgctggcaaagctgatccagaatggtcgcgcgatcgcgccacggctgatccagcaggatcaagcgttcagatgtgatgctgcgtagtgacataacccctccccataaatgacatccgtgcctgctgcgcgggtggtttttaatcaggttaatcgattaactttaaaaatgaaggctggttaacgcgattaacccggcagaatccacattaagacaccggttaccgccaggaatgtgagggctatcaccggacaaaagcctctgctatggttattcgattaaccttcacaggatgaggagcaggcaatggcgacgatcacgctggcgcaggtggcggcaagggcaggggtatcaacggcgaccgtgtcaatggtgctgcgtaaccgcgggcgtatttccccgtccacgcggcagcgggtgctgaaagcgctggatgagtccggctatgtctataaccagacggcggccaacctgcgtaaccgcagcagtaatcaggtcggactgctgctgcacgacatcaccaatcccttttatggcgaaatgaccgcaggcttaagtcacgaaatggagcgccacgatctgctgctgtttctggcgaacagcgaggagtccggcgagcggcagcaaaaatttgtcgattccctgatgcgcaataacgcctgcggcatggtgctgtgcgccgcacgggaaacgccgtcgtcattctttgacgcccttaagcgccgtaacattccggcgatcatggtggtgcgaccggcaagcgatccgcagtttgattttgtcggcaccgataattttcttggcacgcaaatggcgacccgccacctgctcagcctcgggcaccggcatatcgcctttatcggcggcagcgccagctccggcacccgggcgcagcgcatcggcggttttaccagcacgctgcttgagaagggcatttcgccggaaccggcctggctggtgacctcgcaggccagccagagcgatggcgcgcgcgtggcgcaggcgctgctgacgcagtacccgcagatcaccgcagcggtctgctatcaggatattgtggccctcggcgtgatgcaggcgctgcgaaaaatgggccgcgaagtggggcgtgactttgcgctggtgggctttgacgatattactgaagccgcgctggtgcagcccgcgctcaccaccgtatcggtggcggcgaaagagattggccgtaaagccggggagctgctgtacagtcgcattcagggcaataatgagccgccccagcgcattattttaccgcccgcgctggtggtcagggagtcctgcggctttcgctgatcatcatgccttttactgatatttttcggcgtatatcattaaattctaatatcgacgtttttggctggtcgccccgcgcggggctggttactctgaaaacgttttttcagcatttcattaacaaaagagtacaactatgcaagaggcaaacatccgcgtggccatcgcgggagccggtggccgtatgggtcgccagctgatccaggcggcactggcaatggaaggcgtggcgctcggcgcggcccttgagcgcgacggatcgtcgctgctcggcagcgatgcgggtgaactggcgggcgcgggcacaaccggcgttaccgtgcagagcgatcttgaggccgtgaaagacgattttgatgtctttatcgattttacccgcccggaaggcaccctggcgcatctggccttctgccgcgagtacggcaaaggcatggtgataggcaccaccggctttgacgacgcgggcaaagcggccatcagcgaggccgcgcaggacatcgccattgtctttgcggcgaacttcagcgttggcgtgaatgtgatgctcaagctgctggagaaagcggcaaaagtgatgggcgattataccgacatcgaaattatcgaagcgcatcaccgccataaagtggatgcgccgtcaggcacggcgctggcgatgggtgaagccattgcgcaggcgatggataaagatctgaaggagtgcgcggtgtacagccgtgaagggtacaccggtgaacgcgtgccgggcagcatcggttttgccaccgtgcgcgcaggcgacatcgtgggtgaacatacggcgatgtttgccgatattggcgagcgcattgaaattacgcacaaagcctccagccggatgacctttgccaatggtgcggttcgctcggcgttgtggctcaaatctaagcgaaacggtctttttgatatgcgtgatgtgctggatctcaacagtttatagcctttattacctctcgtgatgtggttgtggtaatcataattaattgattacatggggcaatattttattgcccctttatttttgctcttcattgatatttttctattaaacctctaaaagttgcaatcttcttcggtttatttgtttctgtaatgtaaattttgaccatctggtccggttttgcagggtgccagacaaatattccagttttctaaccgcgcaagcgttttcctgcctgatatagctgatcttttcactgcctttgccttctgtggtttgtcagagacgcaaaaacataaataaaaatggtcgaacgggtagacttttgtctcacctgtctctagaatgccgccgtttgccgaaaattcgcgggtaagcaaatttgcattgattcacgggctcattatgaattaatatgcaaataaagtgagtgaatattctctggagggtgttttgattaagtcagcgctattggttctggaagacggaacccagttttacggtcgggccataggggcaacaggttcggcggttggggaagtcgttttcaatacttcaatgaccggttatcaagaaatcctcactgatccttcctactcccgccaaatcgttactcttacttatcctcatatcggtaatgtcggcaccaatgctgctgacgaagaatcctctcaggtacatgcgcaaggcctcgtcatccgtgacctgccgctgattgccagcaactaccgcaatcaggaagatctctcctcttacctgaaacgccataacatcgtggcgattgccgatatcgatacccgtaagctgacgcgtctgctgcgtgagaaaggggcgcaaaacggctgcatcatcgccggtgataacccggacgcggcgctggcgctggaaaaagcgaaagctttccccggccttaacggtatggacctggcgaaagtcgtgtccactcaggagagctacagctggacgcaggggagctggacgcttgaaggcgagctgcctgaagcccgcgcggaaagcgagctgccgttccatgtggtggcctacgactacggcgcgaagcgcaacatcctgcgcatgctggtggatcgcggctgccgtctgacggttgtcccggcgcaaaccccggcagaagaggtgctgaaaatgaacccggacggcattttcctctccaacggccccggcgacccggcaccgtgcgattacgccatcgaggcgattaaaaccttcctcgataccgatattccggtgttcggcatctgtctcggccatcagctgctggcgctggccagcggtgccaaaaccgtgaagatgaaatttggtcaccacggcggcaaccacccggtgaaagacgttgaaaacaacgtggtgatgatcaccgcccagaaccacggttttgcggtggacgagtccaccatgccgtcaacgctgcgcgtgacccacaagtcgctgttcgacggcaccctgcagggcatccatcgtaacgataaaccggcgttcagcttccaggggcacccggaagccagccctggcccgcacgatgccgcgccgctgttcgaccactttattgaactgatcaagacttaccgttctgtcgccaaataatcaggagccataaaagccatgccaaaacgtacagatataaaaagcatcctgatccttggcgctggcccgattgttatcggccaggcctgtgagttcgactattccggcgcgcaggcgtgtaaagcgctgcgtgaagagggttaccgcgttattctggtgaactctaacccggccaccatcatgaccgacccggaaatggccgacgcgacctatatcgagccgatccactgggaagtggtacgcaaaatcatcgaaaaagagcgcccggacgccgtactgccgaccatgggcggccagacggcgctgaactgcgcgctggagctggaacgccagggcgtgctggaagaattcggcgtgaccatgattggcgcgaccgccgacgccattgataaagccgaagaccgccgccgtttcgacatcgccatgaagaaaatcggcctcgacaccgcccgctccggtattgcgcataatatggaagaagcgctggcggttgccgctgacgtgggttatccgtgcattatccgtccgtcctttaccatgggcggcaccggcggcggtatcgcttataaccgcgaagagtttgaagaaatctgttcccgcggcctcgacctttcgccaaccaaagagctgctgatcgatgaatcgctgattggctggaaagagtacgaaatggaagtggtgcgcgataagaacgacaactgcatcatcgtctgctctatcgaaaacttcgacgccatgggcatccacaccggcgactccatcaccgttgcgccagcgcagaccctgaccgacaaagagtatcaaatcatgcgtaacgcctcgatggcggtgctgcgtgaaatcggcgtcgaaaccggcggctctaacgtccagttctcggtgaatccgaaaaacggtcgcctgattgttatcgaaatgaacccgcgcgtttcccgctcttcggcgctggcctcgaaagccaccggcttcccgattgctaaagtggcggcgaaactggcggtaggttacacgctggacgaactgatgaacgacatcaccggtggccgtactccggcctcgttcgagccgtccatcgactatgtggtcaccaagatcccacgctttaacttcgaaaaattcgtcggcgctaacgaccgcctgaccacgcaaatgaaatctgtgggcgaagtaatggcgattggccgcacccagcaggagtcgctgcaaaaggcgctgcgcggtctggaagtgggcgcaactggctttgacccgaaagtgagccttgacgatccggaagcgctgaccaaaatccgccgcgagctgaaagacgcgggcgccgagcgtatctggtatatcgccgacgccttccgcgccgggctgtccgttgatggcgtgttcaacctgaccaatattgaccgctggttcctggtacagattgaagagctggtgcgtctggaagagaaagtcgcggaagtgggcattaacggcctcgacgcggatttcctgcgtaccctgaagcgtaaaggctttgccgatgcgcgtctggcaaccctggcaggcgtgcgcgaatccgaagtgcgcaaactgcgtgagcagtacaatctgcacccggtatataagcgtgtggatacctgcgcggcggaattcgccaccgataccgcttacatgtactccacctatgaagaagagtgcgaatcgaacccgaacccggatcgcgacaaaatcatggtgctgggcggcggtccgaaccgtatcggccagggcattgagtttgactactgctgcgtgcacgcctcgctggcgctgcgtgaagacggttacgaaaccatcatggtgaactgtaacccggaaaccgtctccaccgattacgacacctccgaccgtctgtactttgagccggtaacgctggaagacgtgctggaaatcgtgcgtatcgagaagccgaaaggcgtgatcgtccagtacggcggccagacgccgctgaaactggcgcgtgcgcttgaagccgcaggcgtaccggttatcggcaccagcccggatgccatcgaccgcgccgaagaccgcgaacgtttccagcaggcggtggatcgtctgaagctgaagcaaccggcgaatgcgaccgtgacggccatcgaaatggcggtcgagaaagcgaaagagattggctacccgctggtggtgcgcccgtcctacgtgctcggcggccgcgcgatggaaatcgtttatgacgaagtggatctgcgtcgctactttatgactgccgtcagcgtctccaacgatgcgccggtactgctggatcgcttcctggatgatgcggtggaagtggacgttgacgccatctgcgacggcgaaatggtgctgattggcggcatcatggagcacatcgaacaggctggcgtacattccggtgactccgcctgctctctgccagcctacacgctgagtcaggaaattcaggacgtgatgcgtcagcaggtgcagaagctggccttcgaactgcaggtgcgcggcctgatgaacgtgcagtttgcggtgaaagacaacgaagtctacctgattgaagtgaacccacgtgcggcgcgtaccgtgccgttcgtctccaaagccaccggcgtgccgctggcgaaagtggcagcacgcgtgatggcaggaaaatcgctggccgagcagggcgtgaccaaagagatcatcccgccgtactactcggtgaaagaagtggtgctgccgttcaacaagttcccgggcgttgacccgctgttagggccggaaatgcgctctaccggtgaagtgatgggcgtgggccgtacctttgcggaagcctttgccaaagcgcagctgggcagcaactcgaccatgaagaaaaccggtcgcgcactgctgtcggtgcgtgaaggcgataaagagcgcgtggtggatctggcggccaaactgctcaagcagggcttcgagctggatgccacccacggcaccgcaattgtgctgggtgaagccggtatcaacccgcgtctggtgaacaaggtgcatgaaggtcgtccgcacattcaggatcgtatcaagaatggcgaatacacctacatcatcaacaccaccgcaggccgtcaggcgattgaagattccaaactcattcgccgcagcgcgctgcaatataaagtgcattacgacaccaccctgaacggcggcttcgccaccgcgatggcgctgaatgctgatgccaccgagaaagtgatttcggtgcaggaaatgcacgcgcagatcggtaagtaaattgtcaccccgtcacccggtaaacgcatgttgccgggtgacgcttcgcttgtttctgcctgtctgtttcactgttgttatttcgtaacccattcagagtgttctgtgttttctcccgctcgcagttgtttcatctacagttaaattatccggaacaaaaattcactgaaaacgcggggagaacaccatgcgacataaacttttactggcttcactttttgcagcgacaaccatgatgaccgttgccggttgctcatcaaaccaggaagtaaaaaccaccgacggcagcaccatcgtcaccgacggtaaaccggaagtcgataatgacaccggcatggtctcctataaaaacgccaaaaccggtcagaccgagcagattaaccgtgaccagctgaaaggcatgagcgagctggataactaatctgcaccagcctgataaagacgccctgttacctgccggtaacggggcgttgttttgtaaacggcttataagttttcgctgtaagcgcaaccattaactgtctacactcagggcaaatataagcacggtgcagacaggttactcatgatccttattatttatgcccatccctatccgcggcattcccatgcgaataaacggatgattgagcaggcagagacgctcgacggcgtggaaatccgctctttatacgaactttaccccgactttaatatcgacatctctgccgaacaggcggcggtggaacgcgccgatctcatcgtctggcagcatccgatgcagtggtacagcgtaccgccgctgttgaaactgtggatggacaaagtgctctcccacggctgggcctacggcgagggcggtcacgcgctgcacggtaaacagctgctgtgggcagtgaccactggcggcggcaaacaccatttcgaactcggtgcccatccgggcttcgatgtgctctcgcagccgttgcagtccaccgcgatctattgtggcctgcaatggctgccgccttttgccatgcacaataccttcgttgacgacgacgaaacccttcaggcgcaggcgcgccactataaacaacgtctgactgactggcaggagacacatcatggatagccatacgctcattcaggcgctgatctatctgggatccgccgcgcttatcgtgccggtcgctgtgcgcctcggcctcggatccgttctgggttatctgattgcgggctgcatcatcggcccgtggggtttgagactggtgacggatgcgcagtcgattttacatttcgcagaaatcggcgtggtgctgatgctgttcgtcatcggccttgagctggatccgcagcggctatggaaattgcgcgcttcggtatttggcggcggcgcgctgcaaatgctggcctgcggtctgctgcttggcgcgttttgtatggcgctgggcctgcgctggcaggtggcggtgctgatcggcctgacgctgggactgtcttctaccgccattgccatgcaggcaatgaacgagcgcaacctgatggtctcgcaaatgggccgcagcgcctttgccgtgctgctgttccaggatattgccgccattccgctggtggcgatgatcccgctgatggccgccagcggtgaagccatgacgctcggcagtttttcactttcggcgctgaaagtggtgggcgcgctggcgctggtggtattgattggccgttatgtggcgcgaccggcgctgcgttttgtggcgcgatccggcctgcgggaagtattcagcgccgtggcgctgttcctggtgtttggcttcggtctgctgctggaagaagccggtttgtcgatggcaatgggcgcgtttttagccggggtattgctggcaagctccgagtatcgtcatgcgctggaaagcgacatcgaacctttcaagggactgctgttagggctgtttttcatcggcgtcggcatgtccattgatttcgggacgctggtgacgcatccgctgcgcatcgccgttctgctgctgggtttcctggtgatcaaaaccctggtgctgtggctgattgcccgtccgctgaaggtgccgggaaaacagcgccgctggttcgccgtgctactggggcaggggagtgagtttgcctttgtgatctttggcgcggcgcagacggcgaacgtgctggatcccgaatgggcgaaggcgctgaccctggcggtggcgctgtcgatggccgccacgccgatcctgctggtgctgctgacgcgtctggaaaatgccgctgtcggccagccgcgcgaggcggatgaaattgatgaagaacagccgcgggtgatcgtcgccgggtttggacgcttcgggcagatcgccggtcgtttgctgctctccagcggcgtgaaaatggtggtactggatcacgatcctgaccatatcgaaacgctgcgcaagtttggcatgaaggtattttacggcgacgccacgcgggtggatctgctggagtccgctggcgcggcgaaggcggaagtctttatcaacgccatcgacgatccgaaaaccaacctgcaactgacggagctggtgaaagaacatttcccgcacctgacaattatcgcccgcgcccgcgacgttgatcactttattcgtcttcgccaggctggtgtcgaaaggcctgagcgtgaaaccttcgaaggagcgctcagacttggacgtatggcgctggaagggttggggctgggtcagtacgaggcgcgcgagcgtgccgatctgttccgtcgttataatgcgcagatggtggaagaaatggcgcaggtggataatgacacccagtcccgtgcggcggtgtacaaacgtaccagcgcgatgctgagtgaaatcatcactgaggatcgtgcgcatctgtcgcttattcagcgccacggctggcagggcacggaagagggcaaacacaccggcgatccgcgggatgaaccggcagtgaagccgtcagcagaatgaaaaattttatcattctttaccctgtcgccagtcgacgtgagaatgcgctttacgtatagtggcgacaattttttgcaccgggatacattcaatgatcagtctgattgcggcgttagcggtagatcgcgttatcggcatggaaaacgccatgccgtggaacttgcctgccgatctcgcctggtttaaacgcaataccttaaataaacctgtggtgatgggccgcctgacctgggagtccatcggacgcccgctgccgggacgtaaaaatatcgtcatcagcagcaatccggggactgacgatcgcgtgcagtgggtctcttctgtggatgaggcgattgccgcctgcggcgacgcggaagagattatggtgatcggcggcggtcgggtttacgagcagttcctgccgaaagcgcagcgcctgtatctgacccatattgatgcagaagtggaaggggatacccatttccctgactacgagccggatgactgggaatcggtgttcagcgagtttcacgatgccgatgcgcagaattcgcacagctattgttttgagattttagaccgccggtaatgctctgttccgcccacgcctgaccggtgtgggcggacatccctcagaatgacgccgcttcgtcttcgcccagatccagctggcgattcgaatgctgcgcaaaccaggttttatcttcccagcgcagacaggtcagcacgccgccccagcagcagccggtatccagcgcataaatgccttccggcgtgccttttccttccagcgatgcccagtgaccaaaagcgatgctgtactcttccgccaccggtcccggaatcgcaaaccagggtttcagcggggcaggggcattctccggcacgtctttacagtacatatccagttgcccgttcgggaagcagaagcgcatgcgggtaaaggcgttgctgataaagcgtaaacgcgccagcccggccagttccggcgaccagttgttcggcatatcgccatacatggcgtcgaggaataacgggtaagtgtcgctggccagcacggattcgacgtctctggcgcaggcgatggcggtttccagatcccactgcggtgtaatacctgcgtgggccatcaccagttttttctcttcatccacctgcaacagcggctgacggcgcagccagttgattagctcgtcggcgtccggcgcttccagcagcggcgtaatacgatctttcggcttgttacggctgatgcccgcatacacgcccagcagatgcaggtcgtgattgcccagcaccatgcgcacgctgtcgccaagcgatttcacaaagcgcagcacgtccagcgacgccggaccccgcgccaccaggtcgcccgttagccacagcgtgtccatctgcggatcaaactgcacctgctttaataatgcgatcagttcatcgtagcaaccgtgaacgtcgccaatcagatatgttgacatgtgattaatgaataagtgtagggacggcgagtcggaaaaccggaatggcaatgcggaaagcattcccctgggcatcgatcatttcataatgaccctgcatggtgcccagcggcgtttcaaggactgcgccgctggtgtactgatattcgtcgccggcgtcgatatgcggctgcacgccgacgataccttcgccctggacttcggtttcacggccgttgccgttggtgataagccagtagcgcccgagcacctgcacaggcgtccgccccagatttcgtatggttacggtgtacgcaaagacataacgttcaagctccggtgctgactgagactcaatataaacgctctgtacctgaacacatacgcggggcgaattgctcatgacttaactctccttcggcggcgtattatcaataaggtaattcgccagctggcagtattgcgccacagagatgttctctgcgcgggcgccaggatcaataccaagcgaggcgagaacctcgacgctgaacaaattaccgaggctgttacgaatcgttttacgacgctggttgaatgcttcggtcgtgatacgactcagtacgcgaacctcttttaccggatacggcggcgtggcgtgcggtaccagtctgacgaccgcggaatccacttttggcgctggcgtaaaggccgtcggcggcacttcaagcaccgggatcacctggcaataatattgcgccatcacgcttaaacgaccatacgctttactgtttggtcctgcaaccaggcgattcaccacctctttttgcagcataaaatgcatgtcggcaatggcaccagtatagctaaacaggtggaacattaacggcgtggagatgttatacggcaggttgccaaacacgcgcaaaggctggccgagggtcgtggacagctcttcgaagttcattgtcatggcatcctgctgataaatcgtcagcttaggggccaaaaacggatgcgtttgcaggcgggccgccagatcgcgatccagctcgatcacggtcattttatccatgcgctcgccaaccggctcggtcagggcgccaaggcccgggccgatttcgaccatcgcctgaccgggtttagggttgatcgccgaaacgatactgtcgatcacaaactgatcgttgaggaagttttgcccgaagcgtttgcgggcaagatggccctgatggactctcgtattcattgagtattaataatcattttgatggcgagattaagcgccgtaataaaactgccgacatcggctttcccgtggcccgccagttcaagggcagtaccgtggtcaaccgaggtgcgaataaagggcaggccgagcgtaatatttaccccgcggccaaagccctggtattttagcacaggcaggccctgatcgtggtacatcgccagcaccgcatcggcgcgatcgagatatttaggctggaacagcgtgtcggcgggtaacggaccgctgagattcatcccctgcgcgcgcagttcattgagcaccggaatgatggtatcgatctcttccgtacccatatgcccgccttccccggcgtgcgggttcaggccgcagaccagcacgtgcggttcaccgatgccaaatttagtgcgcagatcgtgatgcaggatggtgatcacatcgcgcagcagggccggggtaatcgcgtctgctacggctttaatgggcagatgcgtcgtcgccagcgccacgcgtagttcttccgtcgccagcatcatcaccactttgctggcctgcgcgcgttcttcaaagaattcggtatgaccggtgaagggcacgccggcgtcgttaatcacgcccttgtgtaccggcccggtcaccagcgcggcaaattcaccgttcaggcagccgtcgcaggcgcgtgccagggtttccaccacataggcaccgttcgccactgacagctgtcctgccaccacgggctcgcgcagcgccacgggtaacagcgttaaggtaccggcgcgttgcggctgcgggggattttcaggttgccagggaagcagcgaaagcgacagaccgagctgggcggcccggtctgtgagaagtgctgcgtcggcgcagaccaccagttccatcggccagtcgcgctgggcgagctgaacgacgaggtcggggccaatcccggcgggttcgccgggagtgataacgacacgctgaacgttcattagttgctcaggattttcacgtaagcgctggcgcgttgttcctgcatccaggctgcgccttcttcggacattttacggttcatcagcatgcggtacgcgcgatctttctgcgccgcatcggtcttgtcgacgttacgggtgtccagcagttcaatcaggtgccagccgaaggaggagtgcaccggtccgctgatctggcctttgttgagcttagtcagcgcatcgcggaatgccggatcgaaaatgtctggcgcagcccagcccagatcgccgccctgattcgcagagcccggatcctgagagaactctttcgccgcattagcaaaggtggttttgccactcttgatgtcggctgcgatctgctcgatcttcacacgcgcctggtcgtcggtcatgatcggcgacggcttaagcaggatgtgacgtgcgtgtacttcggtcacggaaatgctctggctctgaccacgcagatcgttcactttcagaatatggaagcccacgccggaacgtaccggaccgatcacgtcgcctttcttcgccgtgctcagcgcctgggcaaagatagacggcagctcctgaatacggccccagcccatttcgccgcctttcagcgcctgctggtcggcagagtaagtgatcgccagcttaccgaagtcatcaccggcacgcgcctgctcaacaatagagcgcgcctggctttccgcttcgttcacctgatcggaagttgggttttccggcagaggaatgaggatgtggctcaggttaagctcagtgctggcatcgttctgattgcccacctgctgtgccagagattccacctcttgcggcagaatagtgacgcggcggcgcacttcgccgttgcgcacttcggagatcagcatctctttacggatctggttacggtaggtgctgtaattaacgccatcgtaagccagacggctgcgcatctgatccagcgtcatgttgttctgtttagcgatgttagcgatcgcctgatcgagctgctcgtcagtgaccttgacacccattttggtgcccatctgcaggatgatctgatccatgatcagccgctcaagaatttggtgacgcagcgtgttgtcatccggcaattgctggcccgcctgaccggcgttgagtttcacggactgcatcaaaccatcaacgtcactttctaacaccacgccattattgacgacggcagcgactttatcgacaacctgcggcgcagcgaaaccggtgttcgcaaccatagcgagaccgagcagcagcgttttccagttcttcatactttttccatttccattaaccgcaatgcggattacgttgcaaatcaacgacattacaaagtagaacgataaggcagaatgttcgaacgcagcatctgctgggtacccagaccgtagttagaactcaggccgcgcagttcgatgttaaagccgataactttatcgtacttactctggttactttgtggatcccagccgttcagcttacgttcatacccaacgcggatagcgtagcagcaggagttatattgcagaccgaccatctgatccgccggtttgctggtgttggtatcaaaatagtacgcgccgacaatcgaccagcggtcgacgatcggccagcttgccgcgccgcctacctgcgagatgccatctttgtattgatcagaggtgacatcataatttggcagcgccgcctggatatactccgggctggcgtagcgatagctcagctgtaccatacggtcttcgtcgcgacggtattctactgtcgcgctgctggtggctacgttatcaaggcgcgtatcgtactgcaccccgccgcgcagaccccagcggtcagacatgcgccagtaggtatcgcctgcccagaccagcgaaccggtgttgttatctttttcccagttaatattgtcatccccggtacgggactctgagaaatagtagatttgaccaacagaaacgttaaaacgttcaaccgattcgtcatcataaatgcgcgatgtgataccggtagtcacctgattagcagaggcgatacggtcaagaccgccgtaagtgcgatcgcggaacaggccgctgtagtcagactgcagcagcgacgagtcatagtttttaatgccgctctggtcacgataaggcacgtacagatactgcgcgcgcggctccagcgtctgggtaaagttttccgcccagttcatgtcgcgctcgaaaaccattttgccgtcaactttaaactgcggcagcacgcgacttactgagctttcaaggccagctttggtggcattgttatagtcgtcaatattcgtttgctggtaatgggtcgccatgaccttagcttcggtgttcaggctgccccactcgtttgatagtggcaaattgatggtgggttcaagatgtaaacgcgtagcctccggcataatttcattcgcgttaacaaaatgcacagcctgagcatagacgcgggtatcaaagggacccacgtcattctggtagaagttcatatccagctgcggctcagcggaataggagtcgccgctctgggtatcaaacacctggaactgcttggtcgacagcgtggcattgaagttttcaataccgtagcccacgctgaaaatctgcgtggcgtaaccgtcggtgctggaaccgtatttggtggtaaagtcgttgaaataggttggatcgctgactttggtatagttaacgttaaaacgccatacctcatccagcacgccgccatgctgccagtagaacaaccagcggtgacgatcgctctcggtcgggttctcgtcctgataaactttatcagacggcagatagtcaaactccaccagacctgcgcccgcctgggtcagataacggaattcgttttcccactgaatattgccacgcttgtgaatatagtgcggggtaatggtggcatcgaagttcggcgcgatgttccagtagtacggcaggtagaactcaaaatagttcgtggtgctgtatttggcgttcgggatcaggaaacctgagcggcgtttgtcgccaatcggcaactgcaaataggggctgtagaacaccggcaccggcccgagcttaaagcgcgcgttccagatttccgccacctgttcttcccggtcatggatcacttccgaacccaccacgctccaggtatttgaacccggcagacaggaggtgaaggtaccgttatccagaatggtatagcggttttcaccgcgctgtttcatcaggtcggcagtaccacgaccctgacgtcccaccatctgataatcgccttcccagacgttagtatctttggtattcagattcgcccaggctttcggacctttcagaatgacctggttatcgtcgtaatgtacgttacccagagcgtcgacggtgcgcacgggatcggcctggccttccgccacctgctgatgcagctgcatctcgtcggcctgcaaacggctgttaccctgctggacatcaaccttgccggtaaacacggcatcgtccgggtaattgcctttcgcatggtccgcgttaatggtgacgggcagtttattagtatcccctgtcaccagagggcggttatagctcggtacgcccagcatacactgcgaggcaagatcggccgcctgtccgtactggctgtacagagcagaggcaatcatggtggccagaagggtgggaatacgtttattcatacgttgtatttgttgttccgtcatcagtggctttacggcttgcaaacagtcagagactaacttactcaccttcgcagcgctagtgttaatcctgcccgtgatcgagcctgctaaagaaggctgtgcctgtgcacggcatagaatgacgggtatgataatgcaaattttagccgacggcatgacgatttggggagtatatgcagtattggggaaaagtgattggtgtcgccatcgccttaatgatgggcgggggcttctggggcgtgctcctcgggctattgatcgggcatatgtttgacaaggcacgcagccgtaaaatggcgtggtttgctaatcagcgtgaacgtcagtcgctctttttcgccaccacctttgaggtgatgggccatttaaccaaatccaaaggccatgtgacgcaggccgatattcaggtggcaaccctgtttatggatcgtatgaatctgcatggcgactcgcgtgccgccgcgcagcaggcgtttcgcgtcggcaaggcggataactatccgctgcgcgaaaaaatgcgtcagttccgcagcatctgttttggacgcttcgatctgatacggatgtttctggaaattcagatccaggccgcttttgcggacggctcgctgcatcccaacgaacgtgaagtgctgtatgtgatcgccgaagagctgggcatctcccgtatgcagttcgaccagttcttacgcatgatgcagggcggggcgcacttcggcgatggctatcagcagcagtccggcggcgaatggcaacaggcgcagcgcggaccgacgctggaagacgcctgcaatgtgctgggggtgaaacctgacgccgacgccaccaccgtcaagcgcgcttaccgtaagctgatgagcgagcaccatccggacaagctggtcgccaaagggctgccgccggaaatgatggagatggcgaagcaaaaagcgcaggagatccagaaagcctacgagctgattaaagaagcaaaaggatttaaataagcaggcagtctttcccttctccctctcccgggggagaggggctattcagccagaaacagctccagcagcgaattgaggaacagcttaccctgttcggtgatctgccagcaggctgccgactcggtaagatagccaagggcaatggccttatcgatttgcgggcggatcaccgcttcatcaagcccggtgtagcgcgtaaactccgcgcgcggcgccgcttccagcaggcggaagcggttcataaagaactcgaaaggtttgtcctctgccgcgacatcatgctgcttatcaaggtatgtcccctgcatatagccgcgcggatggcgcgttttggcggtacgcaaaatccgcccgtccgggaaggtgactttgccgtgcgcgccgcagccaatgcccagataatcgccgaagcgccagtagttaaggttatgctggcactgatagcctggcttcgcataggctgaggtttcatactgcacatagcctgcggcggtcagtagtttgtcgccctgctcaaaaatatcccacagcgaatcatcatccggcagcaccggcggacgcgagccaaacagcgtgcccggctcaatggtcagctgataccaggaaagatgcggcgggttcagggcaatcgcctggcgcaaatcatccagcgcttcttcaagagactgattcggcagaccgtgcatcagatcgaggttaaaactgcgcagccccagcccggcggccagatgcgccgcccgttttgcttcgtccggcccgtgaatacgccccagacggcgcagcttcttatcgctgaagctttgcacgccaatagagatacggttaacgcctgcccgctgatactcaacgaagcgatccgcttccaccgtgccggggttggcttccatggtaatttcagcgtcagcggcgaggttaagacgcgcccgcacgccgtcgagcagggtttgcatcgccggaccggaaagcaggctcggcgtaccgccaccgataaaaatggtctttacttcacgtccctgggcataggcggcatcggcgtccagatcgctcaacagatgcgccacatagtcgtcatggggcacttcgccctttaacgcatgggagttaaaatcgcagtacgggcatttctgcacgcaccagggaatatgaatataaagactcaggggtggcaaattagccattacgcattgcttccagtaacagtttcagcgcctgcccacgatgggaaatggcgctcttttcttcgcgggtcagttccgcagcggttttgcccagcgaagggacaaagaaaatcggatcgtagccaaagccgccgtttccggcctgctcgcgggtaataaccccctgccagctgccgtggcataccagcggcgtcggatcgtcagcgtggcgcatatacaccagcacacagtggaactgcgcctgacgtttatcgtccggcacgtcctgtaattcttcgagcagtttttcgagattctgctgatcggtagcatcaacgccggagaaacgcgcggagtagatccccggcgcgccgcccagcacgtcgaccgccagaccggagtcgtcggccagcgccggtaaacccgtcactttcgccgcatggcgcgctttgatgatcgcattttcgataaaggtcaggccggtctcttccacggaatcgacgcccagttccgtttgcgccaccacgtcgaggccgaaatcattcaacagcgaggcaagctcgcgcactttaccggcgttaccggtagcgaggacaactttttgcatagtggatcctaattgagtaatgccgcgacgtcagtcgggatagtttgcggatgaataattttaacctgcttatggcggccaagttcgcctttttcaatcaccacctggcttttggcgacgcggaactgtttggcgagatattttaccagatgcgcattggcctggccgtccaccggcggggcggtgatggcgactttcacttcgtcgccatgcagcccgacaatcgcatcccggctggctttcggctgaatatacagccgtaaaaccagcccgtcttcacaggcgcagactgcactcacagcgccatccacagccctggcagcagcatatcgccggtcgactgcaacagctctgcgatacccatattgagcacgtacagcagcagcacgaggatcatcggcgagaaatcaataccgcccatcgacggcagcaggcggcggattgggcgtaacagcggatcggtcagctgcatcagcacgaactccaccgggctgcggccctggcttacccagctcatgatcgccatcgccagcagcacccagaaaatcagcaggccaatggttttaagcaggatcagtacggcggcgatccagataatcggctggaaggtcaccaccataaacagcacaatggctttcagcacgcagagcagaaacgcaaccagcagcgaggcgctgtcaatcggccccatcgccgggatcacccgacgcagcggccccaccaccggctgggtcactttaacgataaactgcgacagtggattgtaaaaatccacgcgggcacactgcatccagatgcgcagcaacaggatcatcgtatagagttcaatgaccgtcgagagcaggaaagtcaacgtcttcatggcgttcctcagttttccttattttttgtgtaatcgcgcgcaccaaagatagcggttccgatgcgcaccatagtgctgcctgccgcaatggcggcgtccatatcgtccgacattcccagtgaaagggtgtcgacggtgggataacgcgctttgagcgcgtcaaatgctacagccatttgccgtgccaccgcaaactgcctttcataatctgacacaggcgcggggatcgccatcagcccgcgcaggcgcacgccgggcaattccgccacctgcgccgccagcgcatccagttcgttcagggcgatgccggacttgctcgcttcgtcactaatgtttatctggatcaggatgttaagcggcgcgagggtcgccgggcgctgctcgctcagacggctggcgatacgcagacgatccacggtatgacaccagtcaaaatgctccgccaccagacggcttttgttggactgcaacgggccgataaagtgccactccagcccggcgacgcccgtctcctgaaagtagcggatcttgtcgacgccttcctgaacgtaattttcgccaaatgcgcgctgacccgcagcgaccgcatctgcgactgcgctcgcaggttttgttttgctcactgcaagcagcgtaacttcttctgaagcacggccgcaacgcgttgccgccgctgagattttatcccgaacctgtgccaggttatgcgctatatcgttcatgtttccaggaggctttatggatatggaagagatcgtggcccttagtgtaaagcataacgtctcggatctacacctgtgcagtgacgggccgccgcgctggcgacgacagggcaggctggaggccgcgccttttccgccgccggatcccgatgccctgttgcaggccacgctcgacgagcggcagcgtgacgagtggcgcacccggcggcaggtggattttgccgtttcgctcaatcagcatcgcctgcgcgccagcgcctttcgccaccatcgcggcatctcgctggcgttgcgcctgctgccggatcgctgcccgacgctggcggcgctggaaacgccgccgctgctgagcacgctactggcgcgggaaaacggtctgatcctggtgaccggggcgaccggcagcggcaaatccaccacgcttgcggcgatggtcaatgcgcttaatcattcgctgcacggccatattctgacgctggaggatccggtggagttcgtgcaccagagtgcgcaatgtctgatccagcagcgggaaatcggcccgcactgcgcctcgtttgccgacggcttaagggcagcactgcgggaagatcccgatgtgattttgcttggcgagctgcgcgatagcgaaaccatccggctggcgctgacggcggcggagaccgggcatctggtgctggcaaccctgcatacccgtggcgcggcgcaggcgatagagcggctggtggacacctttccggcgcaggaaaaagatcctgtacgcagccagctggcgggcagtttacaggcggtactggcgcaaaagctggaggctgacaggcaggggggcagggtggcgctgtttgaactgctggtgaacaccccggcggtggcgaatcttattcgcgaggggaaaacccaccagttgcccggcatgatgcagaccgggcagcaggcaggcatgctgaccttcgcccaaagccaccagcagcgggtggcgcagggcaggctttaaagatcagcgcacgttcagggagtaaacggcgggcagcgccccggcggtggcgacgatctccagacggatgcgcgtggcggtttgcggcgtctcaaaatggtgttcgcagacggagcggtgattgttgcgcacctcggcaagcaaccgctcatcggcccacagacgataatgggtgatgcagtgcggcgtcacggcctgatgatggcccatctgcaccgtttccatagcgttatcaaagtcatgatcctgcaccaatgtcagatgccggaaagtatgcggcgcgggccactgccaggtcacctggggcgcaggatcctgcgcgtcgggcacccagccgttgctgtactgttccgggcgcagccgcccgttaagcaggttatccgggctgaaacagcgcagcggcggatccagtcgcagggcgggcatcacctgatgtggacggcggcgcggtagccagaagtcgaactcatcgacgccgtaatcgccgtcggcgacctggcgggtttgcttcgcgacgcgggcattcaggctgttaaagaccgtcattatgcccggcagtgccgtgtcggtaagggcgatctccacgtcgtcctgcgcctcaaaggcgacgaaaacatactcatcgcgatcgctctgccagcggaaggcgcagcggtgctcgccttcaccggcgacatgcagcacgcactggtcataatgcagttccggcgtaaagttgccggagcgggcgctgcccatcagcgttacgttcaccgtccggcgctgaccggcgcgcagggtaaaggtgagttccggcagcgacgccccggctttgatcggcagcagcagcgccatgctggcagagagcgactgccaggcgccgttgggtggcaactggctgagcggatattcactgctggcgctcacgctggcgcctgccgccgggtcgatcaactgctggcgcgggatataacagccggtggcctgcaaatgctgctggagcgcgccaatattgtcgcgcccggcgagctggcgcggggtgaagccctgctggtggcacagcgcggcggcgcggcctaccacttcccccagcaagccgcaggtgcacatcacccgggcgctgccaaaggcgacgtgggtggcggaaatcaggcgtccggttaagaacaggttatccagcgagcggctgtaaaggctgcgataaggaatggtataggtgcctttactgtgaaattgtcggcagccgtcgtgcgtgctgtacaccccgtcagccggatgcaaatcaatcgaccagccgccgtaggccacggcgtcgtagtggtcacgctgctcaataatgtcctgctggcacagcagatggtcgcccacaaaccggcggctttcgcgcttgccggggatcgcacccacccactcaatggtcatgttgactgcttcagggaactggccggagtttttaatatgatcccagacgccccagacgattttccacaattcccatttgatggcttcgctttcgtgcacggtgtcgagccgtccgccccattccagccaccacagatcgcagccgttcagcgtcgaggtcagccgcttatagcgcgggatagcggtaatgtcaggcagcgcgaaagagggcggaacaaactgcaccgggccgtcagtctgtttggtatagaaatagatcgagtggccgagcttgtggccaaagttatcgccgggggccattttttcgcccagctccgccatatcttccgcgccttcgcggtactccgcgcccgccagatagccgagcacgccatcgccggtggcatcgcaaaactggctggcggccacctcataaaaggtttcattgatcgggttaaaggctttgacctgatgaatacactgctgatacgcctccacttcaaacaccgcagtattaagcagcagcgtcagccccggctggcttttcgccagatccagcagcaccaggtcgaacatcaccgggttaccctctttgttgcgccagaggttctcttcgaggatctcgcccatgatgccgccttcccgcgaccagcggttattgttgcccatatgcgaggtcgcgccgttagcccacagccgtacttcgctggaggcattgcctcccagcaccggcctgtcctggatcagcaccacctgcaagccgtcgcgcgcggcggccagcgccgcgcagagtccggcaagcccgccgccggccaccagcaggtcggttttcagctgcaccgtagggaaggttctcgcatcgcgctggggaaagattttcattatcttgtttccttctgtactggcggtaaaatcgacgttcagaacgcaaaaatggaatgggtgccgctcatgtcgtctcaaccgaatcaaagcctgattgacggcattcgctgtctgcaatacctcgtctccagcggccgggccataggttgtcgcgaactggcgcgcctgatgggcatcaataccacccgcgttaaccgtctgctgatgaccatggcgtccattggcctgacgatgcaggacgaacagcggcgttatctccccggtcccggcattcacgcgctggcggcgcaggccatccgcggttcagcgctcttttcccaggcgctgccgttgctggagcgccatgccccgaaagacatcgtggtggcgctgggcgtgctctgggaggatcaggtgatttatatctatcactcgagtcccgacagacagggcagccaggcgctggcgggttttcatatgctgcccgcttggcaatccgtcatcggcatgtcgctgctggcggcggaaagcgacgaggcgctgatagcgcgtttttctccggaacagtggcagcagctcggtccgcatgtggcgcaacagcgcgcgctcggacgcgtgatctggcatcacgatgacggcgaagtctcaatggcccgcccgctcggttttcactcggcggcgctggcgtttgccgggatgtggcagcctgacgacaaacaagtcaccgcccggctggacgcgctaaaccagctctgtatccagctaacgcaaaaagagtgagcgccaaatcgggctacactgtttcttttatagatacactatcgaaaatgcaaaaagcagggccgtaaagtgtgaggacgatcgagggaatcgtccccgacagcgctcatgcgtgacggggaaggggggatcaaagatgttgttcgaaatagctttcgaggatgatcaccgccgaagcagaatcgacgttgcctttggtgagcgagcgaaagccgccgtgttcaaacagccctgaacgggcttccacggtactcagacgctcatcgtgtaactggatcttcacgccgaaacggccgtggatcttattggcaaaattgcgcgcgcgggcggtcagcggctgttcggtgccgtccatatttaacggcagacccaccaccactgcatccggctgccactctttgagcagcttttcaatcagcttccagtccggcgtgccgtcctgcgctttgatggcagtcagtggccgggcggtgccggtgatacgctggccgatggccacgccgatgcttttggtaccgaaatcaaacgccagtaaggtgccgctcatcaggcatgccccgccacgccaggcatggttgaaatatcaatgccgataagttttgccgcctcgcgccagcggtcggcaatcggcgttttaaagaggatattctgatcggccggggcggtcagccaggcgttgtcgaggatctcctgctccagctggcctttctcccaggaggcgtagcccagcgccaccagcacgtccgtcggctggtcatcggtgcctaaggtttccagcacgtcccgggaggtggtgatcaccgtgttatcggaaatgcggatgctggaggcgaatttggcgggcggcgtatgcagaataaagccgcgatcttccgccagcgggccgccgaggaatactggtttatccaggcggatcgccgggttgcgcgactcaggctgaattttaagtttctcaagcacaccctcaaccttgaggttttccagcggcttattgatgatgatccccattgcaccttcatcgttgtactcgcaaatgtagacaacagcacgacggaagatgggatcctggagagcaggcatggcaatcagaaagtgatgctgtaaattcattgtcaaggttctgtttccggttcaaaaaagcagcaagcgtccagtatgcggggaaagcagcgtgctgtcactagtcagacactggcgggttccctcccgccggatcgtcagagcggattactgaccaagacgcttttcgatggcgtccatcagcatcccggtgatggagatcgggaagacggcttcgatttcacgaatgcaggtcgggctggtgacgttgatttcggtcagacggtcaccaatgatgtcgagaccaacaaaaatcagccctttggctttcagcgtcggggcgacgcggcgggcgatatcccagtcgctgtcgctgagcggacgcggttcgccacggccaccggcggccagattgccacgggtttcgccgccctgcggaatacgcgccaggcagtaaggcacaggttcgccatccaccaccagcacgcgcttgtcgccgtctttgatggcgggcagatagttttgcgccatgcagtagcggctgcccagctcagtcagggtttcagcgatcaccggcaggttcggatcgccttctttcacgcggaaaatcgaggtgccgcccatgccatccagcggttttaaaatgatgtcgtgatgcttttcccagaacgctttcagctgcgccttgttgcgggtgaccagggtttccggggtcagatcggcaaaccaggcggtgaacagcttctcgttacagtcgcgcaggctctgcggcttgttgacgatcagcgtgcctttttcttcggcgcgctcaaggatataagtggcgtagataaattcggtatcaaacggcggatctttacgcatcagcacgacgttaagcgaggcgaggtcaatatcctgctcgctgccgaattcgtaccatttatcgtagttttgctcgacggagagcagacgcgtgcgggcgcgggcttcaccgttggtcaggtaaagatcggccatttccatatagtgcagctcgtagccgcgacgttgcgcttccagcagcatagcgaagctggaatctttcttgatgttaatgtctgcgatgggatccatcacgatgccgagcttaatcattctttttctccgttaccccaaatcgccgaagcgtacttgcagtgcagtaattgcggtgagcgcggtcgtttcagtgcgcaaaacacgtggtcccaacagaatatcagtaaactgatagcgtgcggtcatggcgatttcatcggcagataaaccgccttccgggccgatcagcaggcgaatacggctcaccggcaacggcagcgtgttgatgctggcgctggcgcgcggatgcaaattcagcttaatgccgtcgtcaggctcggcgcaccaggcttccagatccatcgccggacggatttccggtaccacattgcgaccacactgttcacaggcagcgatggcgattttctgccactgctggatcttcttgttcaggcgttcagcatccagtttaacgccgcagcgctcagaaaaaagtggcgtaatgaggcttacccccagttcgatcgatttctggatggtgaattccattttttcgccgcgggacatcacctggcccagatgaatatgcagcggcgattcacgatcgtcggtttccccggacagaacgctgacctcgacgctttttttatccgcacggaggatttcggcgtcaaaaacctgattgctgccgtcaaacaactgaacctgctgaccagcggtcatacgcagtacgcgccccacatggttggcggcgtcatcgttcagcgccacctgctgaccgacagttaaagatcccgggtgataaatgcggggtttacgcatgctagtacttccgtttaatcgctcaataatacgcgccagtgtaagttagctcttttgtgcctgacaagcgcgcagcacgtaagggttgtgatgcccctgcacggcggcgatacggcggtcgcgctcacactcccaactggccaccggatagagtttatcccacgcggtgaaaagctgcgtctgctgacgggacaaagagagctgatactggtcacgcatgtagaaatacgtacgcgcgatagcgcctctggcacgggcaggcggctctgccagcttcgctttgaaatcgactttcatcgggcactgaccgtactggccttcgccgccgttccactggctgtacatgaagttgccgcgatcgccgttcacttcgcctacggaaggttgcaggttatgcatatcgctttccatctggcgatagaccggatctttgctgcaatttttgcggccgccgtcctgccagcactggcgctgatggccgaactgccaggcgggcaccacatgctcccattcgatacggctggcgcggttttcgtttttacgcactttatagccgcaggacgccagatcgacgacgccttttttaccctgccaggtaattttgcagccgcagtaaaaatcgccgggcgcatcggcgttcactttgacgctggccgctttcgcctgcgagaaattgttgatacccccggcaataccgggaaaggaaaggctgccagccagtaaaagggcagcgaaagcaagtttgcgggacatagcctgctccatatctgagtgtgtccgcaccctagcgaaagcggttgtcagatgcaatcagtcagagcataaaagttccgaaaatcaggcctccgccaccagcggctcgccgcagtgcacgcagcgatacacggcttggccgcgcaggatcttgttgtggcggcgcacggtcagctgatgctgctggcaggggcagcggtaagggaaggtattgcggcgcacggacgccagttcaaactgatgagtacggcgcgccggaacgccgagcacgctttccatcatccatttccactctttgccgtgcggcggcacgcggccaaagtgcttccacaccagcagatgcgccagctcatggggcaccacctcgtcgataaaggcctgctgattttccatcagcagcaccgcgttcaggcggatctcatagctttccagccaggcggtgccggcggcagttccccgctgctgatacaccagcgccggttccggataggcgcggttgagtttctgattcgcgagggcgaggttgtcgcgcaggctgcgcataacggcctgttgaatggcgataggaaggcgggtggttttcataacggcagagaatagtgcggtgaaaaaagaagtgcaagaagggcgttgccgggtggcaacgccctgaggcgaacaatcagtcgtgagagccaatctcgcggagtttgcggcccttcatcaggttgcgctcgatatgctccagcgacacatgcttggtttccggcaccagccagagggtcagcacgatgaagaacaggttcaggcccgcgtatacccagaaggtgttggcgttgcccagcgtgttgagcatggtcaggaaggtcgcaccgacgatcatgttggcgatccagttggtggcggtagagcaggtgataccgaaatcgcggcctttcagcggctggatctcagaacacagtacccagatcagcgggccggcactcatcgcaaaaccaacaatgaacatcagcagcataccgacagccacatactgttcggtcggggtatcaatacccacatgcatcatggtacccagtacgcccatgccgaccgccatcaccaggaagcccagcgtcagcgtcggtttacggccccagcgatccaccagaccgatggcgataaaggtcgccagcacgttggtcacacccacaataacggtgccccacatctgctcggtggtattggaataacccgccagttcaaagattttcggcgcgtaatacatgattacgttcataccggtgaactgttgcatcacctgtaacagaatgccgaggaacacggcgcggcggaagttgctgttctctttaaacagcgcccagccgctctgcttaacctgcaggctttcacggatctcatccagttcgtttttcgcttcggcgctggtatcgcgcagacgcagcagcacgcgttcggcatcatggaagcggcgtttcgcggcataccagcgcgggctgtccggcaggaagaacacgccaatcagcagcagcacggccggtatgatgatcacgcccagcatccagcgccatgcgccgctgtagctgaatgcagtgtcagacagataagcgccgagaataccgatagtgatcatcaactggtacattgagatcatgctgccgcgaattttttctggtgcgatttcagacaggtacagcggagcggtataagaggccacgccgaccgcaaggccgagcagcacgcgcgagaggatcagtacttcgacgtttggcgcggcggctgagaacagcgaaccgatcacaaacagcaccgcaccgatcatcaggctctttttacgcccgagacggaaagacagccagccgctacccacagcgcccacggcggcaccgaacatcatggaactcaccacccattcctgcgtgtgcgggctaattttaaactcatcggtaatgaagggcagggcccctgcgatcacaccaatatcaaggccaaacagcagtccggccagtgcggcgaggaaacagacaaaaaacgtcattgccttgttagaacgccccttttttttattatcaggcatatcgcctccggttaagtcacacatttatcgacgtaaaggttaggtgagcaagctattgttttgtgtgatgtaaatcacgctagtgtaatcggttacaccccgcctgcaagactaattgttaaattaattaaatttatcaatagattattatagttttgcaaatcccatgtgaaagtacattcagattaaaccgaagcatgatgtaacaggaggttaaaaatggctgaaaaaacgcaacagggcaggggatggcaggtcaacggtgatgtaatcgctttcagaaaaagacgaactggggcacataaagtatagaccgctcggcaggcggatgggccaggaaaaagcgtaaaaaagcaaaaggccagcacagggctggcctttattacgcgactgtcagcagattatttcaggccggcagcgtcacgcagcacggcagctttgtcggttttttcccacgggaaatgttcgcgaccaaagtgaccgtatgccgcggtttctttgtagatcgggtgcagcagatccagcatctggatcaggccgtacggacgcaggtcgaagaactcgcgcaccagcagggtcagctgttcggtagcgattttctcggtgccgaaggtttccaccatgatggaagtcggttcagccacgccaatcgcgtaggagacctggatttcacagcgatccgccagacccgccgccacgatgtttttcgcaacgtaacgcgccgcgtaggccgcagagcggtccactttcgatggatctttaccggagaaagcgccgccgccgtgacgcgccatgccgccgtaagtatcaacgatgatcttacgaccggtcaggccgcagtcgcccatcgggccgccgataacaaaacggccggtcgggttgatgaagaatttagtggattcgttcagccactcctgcggcagaaccggcttgatgatctcttccatcacgccttcctgcagggctttctgatcgatatcttcagcatgctgcgtggaaagtaccacggcatcgataccgacaattttgccgttgtcatactggaaggtcacctggcttttcgcatccggacgcagccatggcagggtgccgtttttacgcacttctgcctgacgctgcaccagacggtgagcgtaggtgattggcgctggcatcagcacgtcggtttcgttggtcgcgtaaccaaacatcaggccctggtcgcccgcgccctgttccagcggatcggcacggtcaacgccctggttgatgtccggagactgtttaccaatcgcgctcagtacggcgcaggaattggcgtcaaagcccatgtcagaatggacataaccgatgtcacgcacggttttacgggtgatttcttcgatgtcgacccatgcgctggtggtgatttcgccacccaccagaaccatcccggttttcacataagtttcgcaggcgacgcgcgcttttggatcctgttcgaggatcgcgtccagtacggcatcggaaatctggtcagcgattttatcaggatgtccttctgagacagactctgatgtaaaaaggtgttttgccatgttctaagtcaccctggggtaatggtataagctcaaactctgtgccggggccgtcgatgcggcatgcaggttaatgacacaggaagtctaagtgttaatctgtatagatggattaacatctggacggctattttaggtcaattcttgagcccatttccagccttttttgagattcgtcgcattcttcataacagcccaacggcgaattttacttatatgcctgcaaagcctgcttttttattttgctttttgccccctttgacggtataaaacgccgcacgcggcttatcccttgcggcgctttgcgccagggtataaaaaagcgcacgacaacgtttcgtgtcgccacttccagccgggttgagcagttaaattcgcttgggcttatcgctgaccagaccccggttggcgtggaggtgataccagataatgaaccgttgtttaccgctagatctgccatgccgtccggccgggcatcttactcccgctacctgcatatcttcattgcaatcctgccgatgtttaacccatctcggcgcttctcaggactccagagccggtaaggccctgtaatacctgaacaagggcgctcctgttgatcaggggttttctcgtggtttcgctgaaccgtcataatctggttcggatacgtgttttaaaatgatatgaacaagaaaccggtcgcgcagtcggcgtaccagcatagtctgctggccactccgcctgtttatgggttgttatcgctgtgttacgctgcgatagtagtcaactgttttatatccacggtctttcgtgcggcaagggtaattccgacttgcggtaagccgaatttcacagggtatacactttcaactatgtttgaggttcgctatgtctgacgacatgtcttcgccatccccttcgtcagcaggcgaacagggtgtactacgttccatgcaggaggtagccatgagctcccaggaagccagcaaaatgctgcgcacctataatattgcctggtggggcaataactattacgacgtcaacgaactggggcatatcagcgtttgcccggatcctgacgtaccgcaagcgcgcgttgatcttgctgaactggtaaaagcgcgtgaagcgcaggggcagcgtctgcctgcactgttctgcttcccgcagatcctgcagcaccgtctgcgttcaatcaacgccgcctttaaacgtgcgcgcgaatcctatggctacaatggcgactacttcctggtctacccgattaaggtgaaccagcatcgtcgcgttattgagtccctgatccactccggtgaacccctgggtctggaagccggttccaaagcggaactgatggcggtgctggcccatgccggcatgacccgcagcgtgatcgtctgtaacggttataaagaccgtgaatacatccgcctggcgctgatcggcgaaaagatgggccacaaggtctatctggtgatcgagaagatgtccgagatcgccatcgtgctggacgaagccgaacgtctgaacgtcatcccgcgccttggcgtgcgtgcgcgtctggcgtcgcagggctccggtaaatggcagtcctccggcggtgaaaaatccaaattcggcctggctgccacccaggtgctgcaactggtggaaattctgcgtgaacgcggtcgtctggacagcatccagctgctgcacttccacctcggctcgcagatggcgaatattcgcgatatcgccaacggcgtgcgtgaatccgcccgtttctacgttgagctgcataagctgggcgtgaacatccagtgcttcgacgtgggcggcggcctgggcgtggactatgaaggcacgcgctcgcagtccgactgctccgttaactacggcctgaacgaatacgccaacaacattatctgggcgattggcgatgcctgcgaagagcacggcctgccgcatccgacggtgatcaccgagtctggccgcgccgtgaccgcgcaccataccgtgctggtgtccaacatcatcggcgtggagcgtaacgaatacaccgagccgaccgcgccgtccgaagacgcaccgcgcgcgctgcaaagtatgtgggaaacctggggcgaaatgcaccagccgggtacccgtcgctccctgcgcgaatggctgcacgacagccaaatggatctgcacgacattcacgtcggctactcctccggcgcttactccctgcaggatcgcgcctgggcggaacagctctacctgagcatgtgccacgaagtgcagaagcagctggatccgagcaatcgcgcccatcgcccgattatcgatgagctgcaggaacgtatggcggataaaatttacgtcaacttctcgctgttccagtcgatgccggatgcctggggtatcgatcagctgttcccggtgatgccgctggaagggctgaaccaggtgccggaacgtcgcgcggtgctgctggatattacctgtgactcggatggcgctatcgatcactatgtggatggcgacggtattgccaccaccatgccgatgccgcagtacgatccggaaaacccgccgccgctgggcttctttatggtgggcgcgtatcaggaaattctcggcaacatgcataacctgttcggtgacaccgaagcggtggacgtgtttgtcttcccggatggcagcgtggaagtcgagctgtctgacgaaggcgataccgtggccgatatgctggaatatgtgcagctggatccgaaaacgctgttaacgcatttccgcgatcaggtgaaacaaaccgatctggatacggatctgcaacagcagttcctcgaagaatttgaagccggactgtacgggtatacctacctggaagacgagtaatcgactcccgcttcgcccctaatccctttctcgtcgggtttaacgacgcggaggggattttttttatatcgactttacgaaagaggtcacagacatgagcaccttaggtcatcagtacgataactctctggtatctaacgcctttggttttttacgccttccgatgaatttccagccgtatgacagtgatgctgactgggtgatcaccggtgtaccttttgatatggcgacctccggccgtgccggtagccgtcatgggccgggcgcaatccgtcaggtgtccaccaacctcgcctgggaacacaaccgtttcccgtggaacttcgacatgcgcgagcgcctgaatgtcgtcgactgcggcgatctggtgtatgccttcggcgatgcgcgcgaaatgagcgaaaaattacaggcccatgcggaaaaactgctggcggccggtaagcgtatgctctccttcggcggcgaccacttcgtcacgctgccgctgctgcgcgcccatgcgaaacacttcggcaaaatggcgctggtgcatttcgatgcccacaccgacacctacgcgaacggttgcgagttcgaccacggcaccatgttctacaccgcgccgaaagaaggcctgatcgatccgcaccactccgtgcagatcggtatccgtaccgagttcgacaaagacaacggctttaccgtgctggatgcctgccaggtgaacgatcgcagcgtggacgacattctcgcccaggtgaaacagattgtgggcgacatgccggtttatctgagctttgatatcgactgtctggatccggcgttcgcaccgggcaccggcacgccggtcattggcgggctgacctccgatcgcgccattaaactggtgcgcggcctgaaagatctgaatatcgtgggtatggacgtggtggaagtagcaccggcttacgatcagtctgagatcacggcgctggccgccgcgacgctggcactggaaatgctgtatatccaggccgccaagaaaggcgagtaatcgggctattttactcgccattatgggccagggcagtgctcgccatcctcacgtaccaggtgtacgctccggtggctgcgcgctggcctgacccagactggcttcgccaattacgcccgaacagatttatttgatgccgtctgccgccatgcgatcacgaatatgctgcgcacgcgcttcggacgccggatggtcgtcaaacattgaactttgacggcctgcttccagtttagagagcttctcaaagctggttgccagaccggccgggctgatgccgcgtttgcgcaacagatcgtaagagtagtcatccgcttcggattcctggcgttgcgagaactgggaattgaccagtttttcacccagatcgccaagctgcgactgcgacagactacccactacgccaccggcagacgccgccgccacgcgcaccgcgttggtacccagcgccacctgcatgccgcgcttcacatgaccaagcgccacgtgacccatttcatggccgatcaccgcttccacttcgttgtcgttcatcatatccatcaggccgctgtatacgcggatgcagccgttcgccatcgcaaaggcgttcacatctttcgtctcatagaccttgtagttcacggcctggccgttgatgttgtcgcccagcgcgttggcgattttcgccagacgctggctgtaagcgctgctggccggggagatcgtcgctttgctgtccatctctttacaggcttcatcgcttaacgcaattacctgctgatcgcttaatgagtaggcctggaacgcttccgcgccggagctcatcaggccgttagaatccatgttctggcagccggtcaacgccgttgccacacccagagcaagcaatgctgtgcgaatcttcatgtcttatcttccgcaataattaatgcatattttgttagtcgccgcgcctgaacgaagcgggctggtgcgctgagtataaagaatagaacgggatggcggcgagcgtttgcgcaacttgcgagcatgatccagagatttctgaagcggcaaaaggatgctccatgtacatgagttgccgcttgggttacattgttgtcacttttttccggcgtagcccattccgcgctgtagtcaagtcgccagggcatggcctttaacagtccgatctggagtcaaaatgtcctcacgtaaagagcttgccaacgctattcgtgcgctgagcatggacgcagtacagaaagccaagtccggtcacccgggcgcccccatgggcatggcagacatcgccgaagtcctgtggcgcgatttcctgaaccataatccccagaacccgtcctgggctgaccgcgaccgcttcgtgctgtccaacggccacggctccatgctgatttacagcctgctgcacctcaccggctacgatctgccgattgaagagttgaaaaacttccgtcagctgcactccaagaccccgggtcacccggaagtgggctacaccgccggtgtggaaaccacaaccggcccgctgggtcagggcattgctaacgcagtaggtatggctatcgctgagaaaaccctcgcggcgcagtttaaccgcccgggccatgacatcgtcgaccactacacctacgccttcatgggcgacggctgcatgatggaaggcatctcccacgaagtgtgctcccttgccggtaccctcggcctcggcaagctggtggcgttctatgatgacaacggcatctctatcgacggccacgtagaaggctggttcaccgacgacaccgcagcacgttttgaagcctacggctggcacgtggtgcgtggtgtggacggtcacgatgctgacgcgatcaaacgcgccatcgaagaagctaaatccgtaaccgacaaaccatccctgctgatgtgcaaaaccatcatcggtttcggttccccgaacaaagccggtactcacgactcccacggcgcgccgctgggcgatgctgaagtggcactgacccgcgaacagctgggctggaaacacgcggcttttgaaatcccgtctgacatctatgcgcagtgggacgcgaaagaaatgggcgcggcgaaagaaaacgcctggaacgagaagtttgctgcctacgcgaaagctttcccgcaggaagcggcagaattcacccgccgtatgaaaggtgaaatgccggaagatttcgccgcgaaagcgaatgaattcattgccaaactgcaggcaaacccggcgaaaatcgccagccgtaaagcgtcccagaatgcgattgaagccttcggcccgtggctgccggaattccttggcggttctgctgaccttgcgccaagcaacctgaccatctggtccggctcgaaagcgattaacgaagacgccgcaggtaactacatccattacggcgtgcgcgaattcggtatgaccgccattgccaacggtatcgccctgcacggcggtttcgtgccgtacacctccaccttcctgatgtttgtggaatacgcccgtaacgcggtgcgtatggcagcgctgatgaaacagcgtcaggtgatggtttacacccacgactccatcggtctgggcgaagacggcccgacgcaccagccggttgagcagatcgcttccctgcgcgtcaccccgaacatgagcacctggcgtccgtgcgatcaggttgaatccgcggtagcctggaaatacggtgtagagcgtcacgacggcccgaccgcgctgatcctctcccgtcagaatctggcgcagcaggatcgtactgagcagcagctggcagacatcgcccgtggcggttatgtactgaaagacagcgacggccagccgcaggtgatcttcatcgccaccggttccgaagtggagctggctgtaggcgcatgggaaaaactgactgccgaaggcatcaaagcccgcgtggtctccatgccgtctaccgatgcgttcgacaaacaggatgcctcttaccgcgaatccgtactgccgaaagccgtctccgcgcgcgtggcggtggaagcgggtatcgctgactactggtacaaatacgttggcctgaacggcgctatcgtcggcatgaccaccttcggcgaatctgccccggcagagcagctgtttgaagagttcggcttcacggtcgacaatgtggtaagccaggcaaaagcactgctgtaatcgttgttgttaagaaacgggtcgctcaggcggcccgtttttttctatccgcttcatcacttccagtaaattatcaatcgatcgtccctgattaataaagatcgccatattaaacagcaaatcaataagccaggtttgcgatgctttgatcatagacgcatcgctttcatagcgattctgcgaccctccagttaataacgtgacatcagcaaaggacgttaaaggtgaatgcaaatagcgggtgattgccagcgtgctagcgccattctgctttgcgttctgaaaagcatcgaccagatcgcgcgtttctccggtatggctgatgcctattaccagatcctgcttgcccaccagcgcagaattcagcagcatcgtatggttatccgtatgcgcgtcaattcgcatgccgatgcgcataaagcgatactttgcctccagcgcgctgatgcccgacatgccgataccgtacacattgatctggctggcaccgagcagcaaagtcgccgcctgctccagggtagcgttgctttgcagcgccagggtttcgtccagcgatgcctgattaagctgatgcagccgacgcgccacgtccagtaatgagggctgttcggcgggactgtcgctttgaggcagcggttgtagcgactggagctgttctgcggtcagttctcttttcagcgccgcaaaacctgccaggccaatcttgcggcaaaagcgcacgatcgtcgcttcgcccagctgcgttgcgctggcaaggctcgcgatattgcgcatgatcacctgctgctgatgggccagaatataatccgccagccgctgctcggtgcgggtgagttggttgtgatgcattttaattaacgcactgatcgacataaacatcctttaatcacggctgggcgatgatgggggttttaaagagacggtaaaagccaggccgctcatccgtttgaagggcgcgcgaacctcgtcgatgacgagctgctggccagaaaaactgttgtgcagcgtctgctgccagcattgtttaacgcgcgtggcaatagtcgccagaatagccgcttcgtgtttgccgaactgcgcatagctggcgcccagcgcaggcagcacggtttcctgtaccgcaaatcgcacttcgctctgataagcccagtccgacaccagacgttccagcataaaattgcgtgcctgctgcgggcggtcgccgcgacaggcgaaggcgagggcggccagtacggtgcccagcgtattacaggcagtgttccagcctgcataggcgctgaggcgatccagcaggcgatggtgatccagcatttcaattaactcccgctcgccgccgttgctgaaagcgacatcggcaatgccgaccggtttgccaccaatccatgaagccagcgtgtcgcaaaaggcggtaaggctgcggttacggtaataagagagcgctttattgttctgctgcatccagccctcctgcatcaccccgccgcagccgttgatgcccagcagcgcgtccgcatttgccggatcatcacaaagggcaataccgcaggcgcggctgtgggagagcaggctctcttcaaaaggtcgatcttcatactcaggcacaaattgccgaaaagcctgattcgaccagcagaccgcaaatttcagccgcgttggttgccgtgtaagccaggcccgggtcagtaaggtacaacctgattcgtcggtgccggggtgcagccagacgcgatcctgcaggcgattcgcggcgatagcccggtaaagctggcgctgatccatggcggtatagccaaagggcgaggcgtcatcctgtgggatcagcagacacgccagcacaccatcagtaaccagctccaacgcggcctgcgtgacggcgatattgtgctgccgacgctgttcgaaatccgttcttgctgcgctgtccagctctgccgccagacgctgatactccagctgttcttccgccgtcagcagaccctgtgcgtcgcggtcgcggtaaatgccgtactgccagatggcccggccacagtgcgcataataatccggctcttcttcggcggaatcataggcgggggtacgcaggatcagcgaggaggcggagatttctactgccggataacgctgatggagctgacgcagccagtcaaggcgcgcgtgcagcgcctctggcgttaaatgatgcgtacgcgcaggcagcaggccgccgtaaatcagcatatccagcgacaggatcagcgcatcggcaccagccatatgcgcctcgataaacgcggtgagcgcggcaaagtgggcgggtgttttgcggaaaccgagcaaatcacgcggcggcatcactagcgtcagctggctatccatcgccgccagcgactgtagaaaatcgtagttataggggcgggcatccagcggcagacagacaattttcatccgttatgctccttgttccgcttgtttctggcgattcagcgccagcacgaaaggcagatagatcaacaccgaaagtatcagcaacagcagggccagcagcgcggcgcgccagtccccgcccgtggcgagaaatgcggagagcactggcggcgtggtccaggggatcagcacggtggttttatcgatcagctcaagcgcggtggcgaaccaggcgatgccgacgctcaggagcggcgtcagaataaagggcaccagcagcagcggattaaagataagcgggatgccaaaaatcatcggctcattgatgttgaacaacgacggcacgccggaaagccgggtgatggtccggtgatcttcccggcgcgaggcgatgagcatggcgataaccaatccgatggtctgcccgccgccgcccatatatccgaaagcgtcaataaaaggtttggtgacaatgtgtggcggaacagcgccctgctgaagcgcggcggcgttttcctggatcgccaccagcagcgttggctcggtgatcggcatcatgatcgatacgccatggatgccgaaaaaccacagcatattcatgctgaacagcaggccgagcacgccatgcagactttgtaatgcgttttgcagcggcgcctgcacaacctcgttcaccagatggtgcaggttagtgccgaaacatacttcaattaacactgccagcaggccaaacagggtgagcagcaacaacatgggaagaataacgttaaaagagctggctacagcgggtggaacgctgtcaggcatgcggatcgccagatagcgactgcgctgcgccagcgtcaacagttcgctgcttatcagggcgatgataatgccgacaaacaggccgctggcggcggtttcgctggcggcgataaggccgggaacccgaacgatttgatccgccatctgcaacgtctgctcaagggggaaaaagatcaccagacaggccagcgcgaagaccgcatgaatagctcccgcctgttcacgcgcgagcgccatgcgccacgctatcatcgctgttgcgagtagcgtcagaatattgagcgtgccattgtaaatgcgtataccaatttctctggcgggaacaagccagtcggcttttataccgagcagtcccatcagcccggctttttcattcagtaccacattattgatgagtacaaaaaacgaggcggctatgatcagcggcatcagaaaaataaatccttccctgatcgccgtgagatggcgctgcgccgccattctgcctgcccagtaagccagcctgtcgagtgccgcgctggcgttaaatccctttatcatttttcctcctgagtgtttggctccacaagtgcggcggcggcattatggaaaagggcgcggaagaaaagcatgaaggcgatcacgcaatgaatttttaactccagttttttaaataaaatggagttaattcttcacttatgaataaaaaatgttgcgtcgtggctcatggcagagttacggtgcggcgatccccagtaatgccgaggcgggcgactgcccgctcaccagcgcctgggtgctgccgtcccaggcaatgcgcccgtcggcgatcaccagcgagcgcggggcgatgcgcagcgcatcttccacactgtgcgacaccatcagcagcgtcaggttctggcgctgacacacctcgttaaccagcgccagcatctcctgacgcagcgccggatccagggcggaaaacggctcatcaagcagcaataccggctgttcgcgtaccagacagcgcgccagcgccacgcgctgacgttgcccgccggagagctgatctggcagacgatcgagcagcgatcccagccccatctgcgcggcaatgaccgcgagagtggcgcgctgggtgtcgttaagttttaagccgggatgcagccccagaccaatgttctgccgcaccgtcagatgggtgaacaaattgttttcctggaacagcatcgacaccgggcggctcgacggtggcgtacgcgtgtgatcctcgttttccagcatgatcgagccgctgtccggctgtaaaaacccggcgatcagattcagcagcgtgcttttccccgcgccgctcggcccgaggatcgccacctgttcaccccgctcgatattcagcgtaaagcgcatgggcaggtgatggtaaagccaggtggtatcagtcagttttagcatggcgacccggaagtttttcaatcacggtgaacaggataaagcacagcgccagcagcagcagcgccgttacggccccgtcctggctgcgataagagcctatttgctgataaaggtaaaacggcagcgtgcggaaatcgtcattgccgaacagcgccacgacgccaaaatcgccgatcgacagcacacaggcaaacgccagcgcctgcgccagcggacgtttcagcgcgcgcagctccaccacgcgcagccgttgcagccctgccatgccgagagactggcacagcagcgtataacgggcggcgacatcgcgcatcgggttttccagcactttcagcgcgtaggggatggccatcagcgcgttagtaaaaatcacaatgccgtcggcagagtccggcaggccggtggcgttgttaagcagtaaaaagaagccggtcgccagcacgatgccgggcattgcgaggatcaacatgccggacagctccagcgcctgcccggcgaagggttgctggcgggcgcgcagttcgcggctgctccacagcagcatcatggtcaggatcacacacagcaccccggcgcacagtgcgatgcgcagcgaggtccaggtcgcctgccacagcaccggctgcgccagcacgtccagcaggctgcgattcaggccttcgaccatcacggcaatcagcggcggcagcaacagcaacagggccagcacaatcagcgtgccatcggcgaggcggcgcaacagactgtcctgcggatcgcgccagccggtgaggtgatttgtgccgacggcaatggctttgctcagccgctggcttaacagcaccagcccgagacagcagatcatctgcaccagcgccagcaacgccgcgcggcctggttcaaagtcgtaactcagcgcctgataaatcgccagctcaatggtggtggcctgtggtccaccgcccagcgacagcacggtggcaaagctggcgaagcagagcataaagatcagcgcggccaccggcgggatttgccgccgcagccagggccattccacaaagcggaaaaacgcccagccgcgcatcccgagctgggcggcaagctggcgctgctcgccggggatctgctccagcgcctgtaacagcaggcgggtcgccatcggcaggttaaagaagacgtgggccagcaggatcccctgcaggccataaggcgaaaacgtccagtgcgatccgaaaatctgcgccagccagccctgacggccatagacgctgagaatgccgaacaccgccaccagcaccggcaaaatcagcgtcatggcgcacaggcgcaacagcatttgccgccccggaaagcgacggcgatacagcgcgcgggccagggaaatcgccggagccaccgacagcagggcggataaaaacgcctgccagaacgagaagcgcaccacgtgccacaggtaactgtcctgccacagcgcggcgacgtccgttaccggcgcattcagccacagcgcaaaaaaggccgccagcgccaccgccaccatcagtgtggccgcggcggcaccgggcagcagccagccgggaattaacggctgacggcgcgttgccatgcactgatccagtcggcacgcttcgcggcgacatcctgcggggagtattccagcgtggtggccggtttcaccagctggtcaaagcccgcgggcagcgccacgctggtcaccggatacatccagttgccggtggcgatagtgttctggaacgccggggtcaccataaatttcaggaacttcttcgccagttccggctgcttgctggcggcggtgcgggcggcaacttccacctgcaaatagtgaccttcgctgaagcccgcggcggcgtagttgtctttcttctcttcaatggcgtgatacgccggggaggtggtgtagctcagcaccaggtcgctttcacctttcaggaacaggccgtaagcctcgctccagcctttggtgacggtgacggttttcgcggcgagtttttgccaggcgtccggcgtcttatcgccatagactttttgcatccacagcagcaggccgaggcctggcgtgctggtgcgcggatcctggtagatcacacgccatttctggtcgctttccaccagttctttcaggcttttcggcgggtttttcagtttgtttttgtcatagacaaaggcgaaatagccgtaatcgaacggtacgaaggtgtcgtttttccagccgcccggcacgttcactgcatcattcgggatgccgcttttcgcaaacagtttagtttgcgtggccgcttccagcaggttgttatccagccccagcaccacgtcggctttgctgtttttgccttccatgcgcagacggttgagcagcgagacgccatcttccagcgccaccagcttcagctcgcagttgcagtccgcttcaaaggcctttttgactttcgggccagggccccagtcagcggcaaaggagtcgtaggtgtaaacggtaagaacgggtttggcaaaggcgggcgcggcaatcagcagcaggaacggcagacatttttttaacactttgcacctcaataaaagagagtggcaaaggacttgagcggtagcctcaaatcccttcgccggcgttatccggatcaggttcgacgggtattttctcagcacacgcgttccgcgcagcaccccgttgagcacggcgctagtgtaatgattttgttgccgggcagcaatgagggatggttgggggcgaggcccgcgcagaaacacgctgtacgttgctgatgatttactgttgcggagctgagcaaatctggcgcaggggcttgtgctggcctacaggatttcgggtaagcgtaggaaaagtgtattttcctgcgtattcgaaactacaaagccatgatgcaggtagaagtttttcgccgcgtcagagagggcatgaaccataattgcgcgcacacctatattctcagccacacgataaatgcgtaaaacggcatcatgaagtaaatccgcgcccagacctttgccgtggtaactcgcatcgactgcaagacgtgccaggataatgacaggaataggctcaggcatgtttcgtcgtaaactgccgggtgcaatggcgtgagtcacgctgccggtagccagggagtaaaatccaaccacctgtgacgtctttcccctgcataccacaaatgttctggccgcaccggtggagtgattttttaatccccggtgcctgatccattcatccagtactgcttccccacaatgaaactcagaaagaatatgtgaagagttaagcggttgcggagctgttacttttcccactgcggttttctcgccagcagtgtatccagcgccggattagcggtaaccggggcgtccagcatagtgataaattcggcatactgctcatcattgagattgtacattcgacgatcaaggatgacgttttcagcggcctgacaggctgtctcaagtataaaatcagtccgtgatttatgaagaatactggcggcagtatcgataagtgctctctgcgcttctttagccctgatattgagctggacatctgatttcatgttggctccgttgtatagcaagtgatatacaaattttactcttaacgtatagcaaacgctatacgctggtgcatattactcccgctgtactgatttaacatcgaaccacatgctcctggaattgccacctatagttaagagcaggttttaaacgtctttgcgaggcgcgccgcaaaccgtactgccaaatccgcttgccgttgatcgcgtctgacagtagcatcttcccgcacctgcaaaatcaggtgccgggattggtctcctgcatatcatacctgcgacatatgacgcgtaagcgtctttcttatgtcgtgcgtttggctacatctcaatggtgggctggacgggggcgccgcaaggcgcgccggtgtcggtatggccggtaagaccaactccgttcagtccgccacccgtaagattggtctcttcggtggtggaatatacattcacataccggaggctgcccttatggctacgaccctcaaccagactcacctgttacttaccgttccctttaccgcagacacggatttcaccgtgctggcggatcactgcgagcattttgctgaagcgctgatcgaaagcgacgatccggcgctgcgcctcgcgatgtgcgggcgtctgaacgcctgcctgatgctgctacaacccacactgaatgacgttattccaccgcatctgatcccgcaactcacggtggataccccgcctgcggaaccgccgtgtttcgaaccggaatctgatctgctgtgtgaatactgcctgaccttaacacgcctgttgaacagccagtcgctgccgtcggatatggagaaaaccctgaccgggctgctgtgtgaactggtatggtatttcaccgacataatgaaagcgccgcgctgggtgaaagggacagaagcgtagccagccgcaacatcttgccgggtgccacctgtaggcccggcaagcctgcgccgccgggcacgctgcatccttcccataccttcacgcccgccatttcctgctgccctttgtaagatctctaactaaaactgctgtctctgagcgttcaactatactgaatagtgccgttgttatttacgcaggatactgcgtgcagataattacctcatatttaccttaccgatgaccatctggagaatcacatgcaaaagagcaaaaccttgaaaggactgctggccgtatcggcagtggctgcgatgttcaccacgctcggcgtgcaagcccagacacaatccagcactgcaacgagtgacgccaccagccagaccgcatcgggcgctaagctcagttccggggacgaaaaagcggtgaaggatatggcgcaggccaatatcaatgaaatcgccgccgccaagattgcgctgagcaaagcgcaaagcagcgacgtgaaagccttcgcgcagaagatggtcgacgatcatggtgcagctctgaccaaagtccagacggtcgcccagcaaaaaggtgtaacgctgccgacggagccggacgctgagcataaggctatggcagcgaagctggaaaaagcgagcggtgatgactttgacaaaatgtatatggaaaacgccggtactaaagaccacaagatggtgctgacgaaactgcaaagcgatgcgaagatgatcaaagatccggatgtgaaggcgctggctgacgcacatacgccggtcgttgagcagcatctgaaatcagccgagcagatgactaagtaagctggtcgttcggtgggcacagggcccaccgacttttcctttatggctccggcggcgcaaaccacgccgatttaaagtcaaaccaccccagcgtattcatgcgcaggccgcgcatactgcgctgaccgttgatggtcagccagtgatggatcagcggcactatcgcgcggttcgccatcagctgctggcaccagttcgccagattcatttcgcctgcgcgccagtgcgcggcatcctgctgccagtcgcggggaatgcaccgctggagtagcggcacttcgtataaatgcgtgaacagcgaaaaatcgagcggcagcgtgaagttggcgctgttcagccagatatcgcttgtcacctcgccgctgtgccactcctcgtactccacctcctggatctccagccgcacatggtgctgtgccagcagggcgatcattgagcgggcgatgactttgtgctcctgatgttcccggtagtaggtaagggtgagggattccagaccggcgggtttttcgatctcgctaccgccgggtcgcgcgtgatgccagcgcggcagcaggccatatgccggaaaccagaagcgctgatagtgctcgtcgccgtgatacagcaggctagcaggggagagcacatggctgatccagtcccgcaccgccgcattgttgccctttggcgtacgggcatcgaacagcaggtagtagcagccctcttcaagacggctctcaatggctttttcgccctcgccggggccttccagcgtcaggccgccgctgggatcgtcgttcacttccggcagcacccagacgttcacctcatcaatcagcgcgcgaaagccaaagtagtcgtcaaaagcctggatcttcagctggctgctgttgttacgggtgacggcataggggccggtgccgaccggcaggctggcgaagttgctcatcgactcccattcatagggcaggatcatcgactgcacatggcccagcagccagggcaaccagctgtccggctcagagaggtgaatgtccagcgtccagggcgtgggagagacgatctgcgtgatgtgcgaatagagcggaaaggcgttgatacgctcaagggaggtgatgacgtcgcgcatctccagttcgcggccgtggtgaaaatgaatgccgggccgcagataaaatcgccagtgcagcggcgaaagctgttgccagtgatgggcgatatccgcttccagttccccgttttcctcatttacccgcgtcagggcgctgaagatctggcgggcgatatgggtttcagagcgtcttaacgccgtgccgggcagcaggttgcgcagcgggcggtaatagagcacacgcaaaatatggcggccctggcgaaaactgcgccccagatgcgacaccagcatctggcgcacggcggttttgtcgcccaccagctgcaccagctgatcgatacgatcctgctccagcagatcttctgcccgctgctgttgcaacgccagcccggtataaaggaaggtgagacgtgagcgcttaccccgtccggcttccgcttcccatgtcagccagccgcgcgcctgcatggtgttgagcagggtacgcatatggcggcgcgaacagctcagcagttccgccagttcgctcagcgtggtttccctggaagcgccgtcgcaacactgccacaggcggatgaattgttgttgcagacggcccgacgacataaaaggggaactcctgacgaaaactcatcaatttattaatccctatattaagccaatactgaacgtcgatggaagcggggagggctgctacagcattcgcttccaccatgtgtgactgagtattggtgcttatcgccacgccagcaggtatcatctgctggcttttttcattgtttgcgcgcgcaaaaggacgaattatgctgtggcttatgacgatgggcagacgtctgaacggggtctatgccgcgtttatgatcgttgcctttatgatggggatcgccggcgcattgcaggcgccgacgctcagtctgtttctcagccgtgaggtgggcgcgcaacccttctgggtgggcctgttttataccgtcaacgccatcgccgggatcctggtgagcctgtggctggcgaaacgatccgacagccggggcgatcgccgcaaactgatcatgctctgttgcgccatggccatcggcaatgcgcttttgtttgccttcaaccgccactatctgacgctcattacctgcggcgtgctgctggcctctatcgccaataccgccatgccgcagctgtttgcccttgcgcgggaatatgccgataactcggcgcgtgaagtggtgatgttcagctcggtgatgcgtgcgcagctgtcgctggcgtgggtgatcggcccgccgctggcctttatgatcgcgctgaattacggcttcaccgccatgttctgcatcgccgccgggatcttcgccatcagcctggcgctgattgcgctgatcctgccgtcggtggcgagggtggagcaggcggccgatgtgccggtcacccgcgtcagcggctggggcgacaaaaacgtgcgtctgctgtttatcgcctccacgctgatgtggacctgcaacaccatgtacatcatcgatatgccgctgtggatcagtgccgatctggggctgccggataagctggcggggatcctgatgggtacggcggcagggctggaaatcccggcgatgatcctcgcaggcttctacgttaagcgcttcggcaaacgccgcatgatgactctcgcggtggcggcgggcgtgctgttttatatcggcctgattttcttccacagccatgtggcgctgctcatcctgcaactgtttaacgccatttttattggcattgtcgccgggatcggcatgctgtggttccaggatctgatgccgggccgggcaggatcggcgaccacgctgttcaccaacagtatctccaccggcgtgattttagccggggtgatccagggcgcgctggcgcaaagttacggtcacggggtggtgtactgggtgattgccgggatttcgctggtcacgcttggcatcaccagccgggtgaaggacgtgtagatgcgtggtatgtgccgggtggcggctgcgccttacccggcctacaagatgtggtggtatgtgccggatggcggctgcgccttacccggcctacaaggtctggtggtatgtgccggatggcggctgcgctttatccggcctacaagatgtggtggtatgtgccggatggtggctacgccttacccggcctacgagtgacattgtaggccggataagcgaagcgccatccggcaacgggcttagcgcataaacgccggttgttttgcttcgtaagacgcgatggcgtcgtcgtgctgcaaggtcaggccgatactgtccagcccgttcagcatacagtggcggcggaaggcgtcgatgttaaagcggtaggttttatccccggccttcacctcctgcgcttccagatccacttcaaagcggatccccggattggacttcaccagttcaaacagttcatccacttcggcgtcgctcagcttcaccggcagcaactggttgttgaagctgttgccgtagaaaatgtcggcgaagctcggagcgatcaccactttgaaaccgtaatcggtcagcgcccagggggcgtgctcgcgggatgaaccgcagccaaagttttcccgcgccagcaaaatggacgcgcctttgtagatcgggaaattaagcacgaagtccggatccggctgctggcctttgtcgtccaggaaacgccagtcattaaacagatgcgcgccaaaaccggtacgggtcactttctgcaaaaactgcttcgggatgatcgcgtcggtatcgacgttggcggcatccagcggaaccaccaggccggtatgttgaataaatttctctgccatgatggtgtccttatttcaggttgcgaatatcagcgaagtgaccggtgacggcggcagccgctgccatggccgggctcagcaggtgcgtgcgtccgccgcggccctgacgtccttcaaagttacggttgctggtggaggcgcaacgctcgccggggttcaggcggtcattgttcattgccagacacatggagcagcccggcagacgccattcaaaaccggcttcgatgaaaatcttgtccagcccttccgcttccgcctgagctttcaccggcccggaacccggcaccaccagcgcctgtacgcccggcgcgactttgcgcccgcgggcgatgtcagccgccgcgcgcagatcttcaatacgcgagttggtgcaggagccgataaatactttatcgatagccacctcggtcagcggcacgcccggtttcaggcccatgtaggccagcgctttttccgcggaggcgcgttcgaccggatcggcaaaagaagccggatcgggaataatatcgttcaccgagatcacctggccggggttggtgccccaggtcacctgcggggcgatctcttcggcgcgcagcgtcaccacgctgtcaaactctgcatcttcgtcgcttttgagggtggaccagtacgccaccgcctcgtcaaaatcgtggtctttcggcgcgtgcagacggcctttcacatagttgaaggtggtttcatccggcgcgaccaggcccgctttcgcgcccatctcaatcgccatgttgcacagcgtcatgcggccttccatgctcagggcgcggatcgcgtcgccgcaaaactccaccacatagccggtaccgccggcgctgccggttttgccgatgatcgccagcacgatgtctttcgcggtgatccccggcgctgcctggccggtgacttcaatcttcatggttttcgcgcggccctgtttcagggtctgcgtcgccagcacgtgttccacttccgacgtgccgatgccgaacgccagcgcgccaaatgcgccgtgggtggcggtgtgggagtcgccgcagacgatggtcatgcccggcagggtgatgccctgttccggccccatcacgtgcacgatcccctgatacgggtggttcagatcgtaaagttcgacgccgaattcgttacagttcttgatcagctcctgcatctggatgcgcgccatttcgccggaggcgttgatgtctttggtctgcgtcgagacgttgtgatccatggtggcgaaggttttacccggctgacgtaccgggcgcttgtgggcgcgcaggccatcaaacgcctgcggcgaggtcacttcgtgcaccagatggcggtcgatatacagcaacggggtttcgtctggcgcttcatagacgacgtgcgcatcaaacaatttttcatacaagctcttagccatgatcacaccccttcggaaacataacgggcaataatgtcgcccatttcatcagtactgacggccgcgccgccgtgggccaggtcaccggtacgcacgccttcttccagcgcgcggttaatggcgacttcaatggccgtggcggcctcgttcgcgtccaggctgtagcgcagcagcagcgccagcgacaggatctgcgcgatcgggttggcgatatttttcccggcgatatccggcgcggagccgccggcgggttcgtacagaccaaagccctgctcgttcaggctggcggacggcagcatacccatggaaccggtgatcatcgcgcattcgtcagacaggatgtcgccgaacaggttggagcacagcagcacgtcaaactgcgacggatctttaatcagctgcatagtggcgttgtcgatatacatatgcgccagctcaacgtccgggtattcctgcgcgatttcgttcacgatttcgcgccacaggatcgacgactgtaatacgttcgctttatcgatggaggtcactttgtggcggcgtttacgcgccgattcaaaggcgatacgcgcgatgcgttcgatctcaaaacggtgatacacctcggtgtcgaacgctttttcgtgctgaccgctgccttcgcggcccttcggctgaccaaagtagataccgccggtcagttcccgcacgcacagaatgtcgaagccgttcgcggcgatatcggcacgcagcgggcaaaaggcttccagcccctggtacagcttcgccggacgcaggttgctgaacagcttaaagtgtttacgcagcggcagcagcgcgccgcgctcgggctgctgatcgggcggcagcttttcccatttcgggccgccgacggagccgaacagcaccgcatcggcctgttcgcagccttcaacggtggcctgcggcagcgggttgccgtggcggtcaatggcgataccacccacatcgtagtggctggtggaaatacgcatgtcaaaacggttacggatcgcgtccagtactttcagggcttgcgccatcacttccgggccaatgccgtcgcccggcaaaactgcaatatgataatttttagacattacacggtttcctgattgttttctttaatagctttgcgttgcagttctttttcgacttcgttagcacgccagatattgttcagcacgtgcaccatggctttggcggaggattccacgatatcggtggccagacccacgccatggaagcgacgcccgttatagttcgccacgatgtccacctggcccagcgcgtctttgccgtggcctttggcggttaactggtatttcaccagctcaatgttgtagtcggtgatgcggttgatcgcctggtatacggcgtcgaccgggccgttgccgttggcggcttcggctttcacgtcatcaccgcatgccagcttcacggaggcggtggcgatgtcgttagagcctgactgcacgctgaagtaatccagacggaaatgctccggctcttcctgctgcttattaatgaaggctaaggcttccagatcgtaatcaaagacctggccttttttatccgccagcttcaggaaggcgtcgtacaggttgtccaggttgtagtcgctttctttataacccatctcgtccatgcggtgtttcacagcggcgcggccagagcgggaggtcaggttcagctgcacctggttcagaccgatggattccggggtcatgatttcgtagttggagcggtttttcagtacgccgtcctggtgaataccggaggagtgggcgaaagcgccggtgccgacaatcgctttgttggccgggatcggcatgttgcagatctggctgaccatctggctggtgcgccagatttcctgatggttgatacgggtgtgcaccttcatgatgtcctggcgtactttgatcgccatgatcacttcttccagcgagcagttaccggcacgctcgccgataccgttcatcgcaccttcgacctgacgcgcgccggcgttaacggcggccatggcgttgccgacggccagccccagatcgtcatgggtatgcacagatataatggctttatcaatgttcggcacgcgctcatacaggccgctaatgatactggcgaattcgaacggcatggtgtagccgacggtatcaggaatattaatggttctggccccggcgttgatcgccgcttcgaccacgcgcgccaggtcttcaatcggcgtgcggcctgcgtcttcacaggagaactccacatcgtcggtatagttacgggcgcgtttgaccatgtagaccgcgcgctcaatcacttcatccagcgtactgcgcagtttggtggcgatgtgcatcggggaggtggcaataaaggtgtgaatacggaaggcttccgcgactttcagcgactccgccgccacatcaatatctttctccacacagcgcgctaaagcacagacgcggctgtttttaacctgacgggcgatggtctgcacggattcaaaatcgccaggggaggagacagggaacccgacttccatgacgtcaacacccatacgttccagcgccagcgcgatttgcagtttttctttcacgctcaggcttgcctgtaatgcctgttcaccgtcacgtaaggtcgtatcgaaaataatgacttgttgctggctcatggtttaggtccttttctgtctgagggcgctttgctacgagcataaaaaaacccgcgcaatagcgcgggttcgttattctaccgggagatgacttaattctgcgtgtcgcccaccagtccaccgcgcaaggaagatgcgtttagtagtagtagaccggcgaaacgaacgtggcgaatcatgtgtcatgctccagatgaatacaatatgcttctagtggtactggatacgtaatctgatgtcaacccccgatcccggaaatgcacttttttaagcgcgtcagccgtatggcgtgatgaggtaattgtgctgtatctgacagcaaaggcagtgacatcctttttcaaaaaatgacgcgcttgcattttgtgacaaatacacatgactgcttatttttgttcgcaagccgcaatgacgattttcctgtctgtatcgctatgattttccattacttgtttcagatactggttttgtctcaggaatatattgttaagtattgtacttatcatgttaattctctggtgctttattgttttgagttaagagaaactgaaatggcgattaaataaaagtgattatgtatattcatggtgtttatgtttttatttgcgtcaagttatacggtgaatgtgttgatcactaatccgccgcattgattaccaaatttaatcgctttactcatcaagagatctttatatattcctattttgtaaaaatcttcttttgcttgtttcatatgcatggtaaataatatttcacgaaattattactgcataagtaaagggaggttggcgtgacagtggagttcaatatgccagaagaaaacattaccaatattaatccatccgaagcgacgaaacccaagctgcgaatggtcgaccttaatttactgacggtatttgatgtggtgatgcaggagcaaaacatcacccgcgccgcgatgcatttacagatgtcgcaacccgccgtcagcaacgcggtcgcccgtctgaaagtgatgttcgatgatgagctgtttgtccgctatggccgcggcatccagcccactgcgcgtgctttccagctgtacggatctgttcgccaggcgttgcagcttattcagaatgaactgccgggagcgggtttcgagccgattaacagcgcacgggtatttaatttatgcgtctgtagtccgctggataattatctgacgtcggtgatttataatcgcgtcgaagaaatggcccccaatattcatttagtctttaaatcttccctcaatcacaatactgaacatcaactgcgttatcaggagattgagtttgtgattggttatgaagaatttcgtcgtccggagttttcctgtattcctctgtttaaagatgaaatggtgctggtggccagtaaaaaacatccgcgcctgacgggtccattacgggaaagcgatgtttataatgaagagcacgcggtggtggcgctggatcgttatgcctcttttagccaggcatggtatgacacgccggaaaaacagcgctgtatcgcttatcagggcatggcattaattagcgttctgaatgtcgtatcgcaaacgcatctggtcgctattgcgccgcgctggttagcggatgaatatgccgagaaattagaattacaaattctgccgttaccgctgaaattgaatagccgcacctgtttcctttcctggcacgaagcggcagggcgcgataagggccatcaatggatggaggagttgctggtttccgtctgccgtcgttaaatcttaacagacgcgcagcgtcttatttattctgttaatcatttataatgcaatattttctactaatgcatttttaacgtcagccttcgcgcgacgttaaaaatgcatgattacctgtctcattcccttttaccgtgacgattggtcatcgtctttacttatcatggtgtattcttctttctgagcttcgccgacctcttatttcttcttcctgatgactgtcgggctaaacctttgccaattgcctgcctgattttgagcggttaaggtgatcctcaaataacaaaataacgcctggaggcaaaccatggagatgttgtctggagccgagatggtcgtccgatcgcttatcgatcagggcgtaaagcaagtattcggttatcccggaggcgccgtccttgatatatatgacgccttacatacggtagggggcatcgatcatgtgctggtgcgccatgagcaggcggcggtgcatatggcagacgggctggcacgcgcgaccggtgaagtcggcgtcgtgctggtgacttcaggaccgggcgccaccaacgccattaccggtatcgctaccgcgtatatggactctattccgctggtagtgctctccggccaggtggcgacctcgctgattggctacgatgccttccaggagtgcgacatggtgggcatctcccgcccggtggtgaaacacagtttcctcgtcaaacagacagaagacattcccggcgtgctgaaaaaggccttctggctggcggcgagcggccgtcccggcccggtggtggtcgatttgccgaaagacattatgaacccggcgaacaaattcccttatgtatggcccgagtcggtcagcatgcgttcttataatccaaccacccagggtcataaaggccagatcaaacgcgcgctgcaaacgctgatcgcggcgaaaaatccggtggtttacgtcggcggtggagcggtgaacgcgggctgcgaagcacagctgcgcgagcttattgaaaaactcaatctgccggtggcgtcatcattaatggggctgggggcgtttccggccacgcaccgtcaggcgctcggcatgctcgggatgcacggcacttacgaagccaacatgacgatgcaccattccgatgtgatcttcgccgttggcgtgcgtttcgacgatcgcaccaccaataatctgatgaagtactgtccgaatgcctccgtgctgcatatcgacatcgatcccacgtccatttcaaaaaccgtggcggcggatgtgcctattgtcggcgatgcgcgtcaggtgctggagcagatgctggaactgctgggacaggaaacctccagtcagccgctggacgatatccgcgactggtggcttaagatcgaccagtggcgcgcccggcagtgtctgaaatatgacaccagcagtgaaagcattaagccgcaggcggtgatcgaaaccatctggcgcttaacccagggcgacgcctatgtgacttccgatgtcggtcagcatcagatgtttgccgcgctctattatccctttgataagccgcgtcgctggatcaactccggcggcctcggcaccatgggcttcggcctgcccgcggcgctgggcgtaaaaatggcgctgccggaggaaacggtgatctgcgtaaccggtgacggcagcatccagatgaacattcaggaactctccaccgcgttgcaatacgagctgccggtgctggtgctcaacctgaataacggttatctgggtatggtgaagcagtggcaggacatgatctattccggccgccactcccagtcctatatgaactccctgcctgattttgtgcgtctggcggaagcctacgggcatgtgggcatgcgcattacccatcctgccgaactggaaagtcagctggcagaagcccttgcgcaggtacgcaacaatcgtctggtgtttgtcgatgtctgcgtggatggcagtgaacacgtttatccgatgcatattcgcggcggcggcatggatgagatgtggttaagcaaaacggagaggacctgattatgcgccggatattatctgtgttactggaaaacgagtccggggccttgtcccgcgtgatcggtctgttttcccagcgcggctataacattgaaagcctgaccgtagcgcccactgacgatcccacgctttcgcgcatgaccattcagacggtgggcgatgcgaaagtgcttgagcagatcgaaaagcagctgcacaagctggtggacgtgctgcgcgtcaatgaactggggcagggggcgcacgttgagcgtgagatcatgctggtgaaaatccaggctagcggatacgggcgtgaagaagtgaagcgcaacgccgaaatcttccgtggacagatcatcgacgtgacgccgtcgatttacacggttcagcttgccggcaccagcgataagctggacgcttttctggcgacgatccgcgatgtcgccaaaattgtcgaagtggcacgctccggcgtggtgggtctgtcgcgcggcgataagatcatgcgttaagacgatagcgccagcctaaatcccggcccgacactccctgtcgggcttttttttgcgaattcaattgaaagcatgcgcgaaagcggttgccgcagtgactattctgcgtttagatgttatggaatttaacctatatcctcaaaaaggttatggagtatctttttttcttgagaggcaattgtgaaactggatgaaatcgcccggctagccggcgtctcacgtaccacagccagctatgtcatcaacggtaaagcaaagcagtatcgtgtcagcgataaaaccgttgaaaaagtcatggccgtggtccgtgagcataactaccatccgaatgcggtagcggccgggctgcgtgcaggacgtacgcgatcgattggactggttattcccgatctggagaacaccagttatacgcggattgcaaactatctggagcgccaggcgcggcaacgcggctatcagttactgattgcctgctcggaagatcagccggataacgaaatgcgctgcattgaacatctgctgcaacgacaggtggatgccattatcgtctccacctcgttaccgccagagcatccattttatcagcgctgggctaatgacgcgttccccatcgtcgccctcgatcgcgcgctggatcgtgagcacttcaccagcgtggtcggtgccgatcaggacgacgccgaaatgctggccgccgaattgcgcaccttccccgctgaaacggttctgtatttaggcgcgctgccggagctgtcggtaagcttcctgcgcgagcagggattccgcaccgcctggaaagacgatccgcgcgaagtgcagtatctctacgcgaacagttatgaacgggaagccgccgcgcagctattcgaaaagtggctggaaacacacccgatgccgcaggcgctgttcaccacctcttttgcgctgttgcagggcgtaatggacgtcacgctgcgacgcgatggcaagctgccatcgaatctggctattgccacctttggcgaccacgaactgctggacttcctgcaatgcccggtgctggccgtcgcgcagcgtcaccgtgatgtggcggagcgcgtgctggagatcgtcctggcaagcctcgatgaaccgcgcaaaccgaagccaggcctgagccgtatccggcgtaatctgtaccgccgcggcatacttaaccgtatttgagttccacccgaaaggcagccatagctgcctttttcttttctgctggttttaaattatcacgcctgcttaagaatcagattaatccttaaaaaatccaggggcgttaataacgaaggcgattaattatctgtggcctgtttttcatcattataagaagtaagcattcgtatattttgaattgttttgttacatcctcatctgatttgccgaattaaccatcacttttcccggcggcttttataaattgcgcttatggccgcgcagccgcggcatgcgcagctttaacgggcgctgtcatctgaatgcaatatggcttaaaatgccgcccgcgtcgcaaactgacactttatatttcagcactgctaagaagtgtgagggagcgctcatgaagaaattcggtttattttcttacaaatattcatgacgttaattcgcagtgcaggtagggcaaaatttccccggtgccgatcgctgtctgatgctggctggcttttaaatcgcttagcgtcagtgctggcttgacaagcttttcctccgctccgtaaactcctccagtggagatttgtgggataaagtggtgaaaagggtcatggtgaggtgaaactggcatgttccgtggagcaacattagttaatctcgacagtaaaggccggctcgctgtgcctacccgtcatcgggaatatctggtcgggcacgcttctggtcaactggtttgcaccatcgacatccaccacgcctgtctgctgctttatcctctcccggaatgggaaattattgagcaaaaattatcgcgtctgtcgagcatgaacccgctggagcgacgcgtgcagcgtttactgctgggccatgccagtgaatgtcagatggacagcgcgggccgtttactgataccgcccgttttacggcagcacgccggactaaacaaagaagtgatgctggtcgggcagtttaataaatttgaactgtgggatgaaacgacctggtatcaacaggtcagggaagatatcgacgctgagcaatctggtgctgaacagctttcagatcgattgcaggatttgtctctataacgatgatggataattttaaacatactacggttctgctggatgaagcggttaacggccttaacatccagccggacggcatttacattgacggcacctttggccgcggtggacattcacgtttgatcctctctcagttgggagtggaaggtcgcttactggctatcgatcgcgatccagaagccattgccattgctaataccattgatgatccccgcttttctattgtgcacgggcctttctcggcgctggcagattacgttgctgagcgcgggctgaccggcaaaatcaacggcattctcctcgatctgggcgtttcttctccgcaacttgacgatcctgagcgcggcttttcctttatgcgcgatggcccgctggatatgcgtatggatccaacgcgcggccagtctgccgccgaatggctgcaaaacgcggacgaagctgacatcgcctgggtgctgaaaaccttcggcgaagagcgtttcgcaaaacgtattgcgcgcgccattgtcgagcgtaatcgtctcgatccgatgacccgcaccaaagaactggcggaagtggtcgctgcggccacgccgattaaagataagttcaaacaccccgcgacccgtaccttccaggcggtgcgcatctgggttaacagtgaactggaagaaattgagctggcgctaaaaaactcgctcaacgtgctggccccgggaggtcggctttccatcatcagtttccactcccttgaagaccgcattgtgaagcgctttatgcgtgaaaacagccgtggtccgcaggttccggcgggattaccgatgacggaagcacaactcagcaagctgggtggccgttatctgcgggcattaggcaagttgatgccgggcgatgaagaagtggcagagaacccacgcgcccgtagttcagttctgcgcatcgcagagaggactaacgcatgatcagcagagtgacagagaccttcagcaaggttaaagaatcgttaggaagcaacgagcgccatgccttgcctggcgtgatcggcgacgatcttttgcgatttgggaaactgccactctgtctgttcatttgcatcattgccacagcggtgacggtggtcactaccgcgcaccacacgcgcttacttaccgcccagcgcgaacagctggtggtggagcgcgatgcgctggacatcgaatggcgcaacctgatccttgaagagaacgcgctcggcgatcacagccgggttgagcggatcgccaccgagaagctgcaaatgcagcatgtcgatccttcgcaagaaaatattgtcgtacaaaaataaggacttacccgacgcatgaaagcagcggcgaaggcgctaaaaccgaaacgccaggaagaacaggccaactttattagttggcgttttgcgttgctttgcggttgcattctactggcgctggcatttttgctgggtcgcgtagcatggttgcagatcatcaacccggatatgctggtgcggcagggcgacttacgctcgctgcgcgtgcaggaagtgtccacctcgcgcggtatgatcaccgatcgctctggccgcccgctggcggtaagcgtgccggtaaaagcgatctgggccgatccgaaagagctgcatgacgcaggcggcatttcgctggataaccgctggaaagccctttccgacgcgctgaatatgccgctggatcagcttgcggcgcgcgtcaatgccaacccgaaagggcgctttatctatctggcgcgccaggttaacccggatctgggcgattacatcaaaaaactcaaactgcccggcattcacttacgtgaagagtctcgccgttactacccttcaggcgaagttaccgctcacctcatcggctttaccaacgttgacagccagggcattgaaggcgtcgagaaaagctttgataaatggctcaccggtcagccgggggagcgcatcgtgcgtaaagaccgctacggtcgcgtgatcgaagacatctcttccaccgacagccaggcggcgcacaacctggcgctgagtattgacgagcgcctacaggcgctggtgtaccgagaactgaacaacgccgtcgcctttaacaaagcggaatcaggcagcgcggtgctggtggatgtgaacaccggcgaagtgctggcgatggcgaacagcccctcctataacccgaataacctcaccggcacgcagaaagatgtcatgcgtaaccgtaccatcaccgacgtcttcgaacccggttcgaccgtcaaacccatggtggtgatgacggcgctacagcgcggcgtggtgcgggaaaatacggtgctcaacaccgtgccttaccggatcaacggtcacgaaatcaaagacgtggcgcgttacagtgaattaaccctcaccggggtattgcagaagtcgagtaacgtcggtgtttcaaagctggcgttagcgatgccgtcctcagcgctggtagaaacttactcgcactttgggctgggaaaagcgaccaatttggggttggtcggagaacgcagtggcttatatcctcaaaaacaacggtggtctgacatagagagggccaccttctctttcggctacgggctaatggtaacgccgttacagttagcgcgagtctacgcaacgatcggcagctatggcgtttatcgcccgctgtcgatcaccaaagttgatcccccggtgccgggcgaacgtatcttcccggaatccattgtgcgtaccgtggtgcacatgatggaaagcgtggcgctgcctggcggcggcggcgtgaaagcggcgatcaaaggctatcgcattgccatcaaaaccggtacagcgaaaaaggtcggcccggacggaaaatacatcaataaatacattgcttacaccgcaggcgttgcgcccgccagtcagccgcgtttcgcgctggtggtggtgattaacgatccgcaggcgggtaaatattacggtggcgccgtttccgcgccggtgttcggtgccatcatgggcggcgttctgcgcaccatgaacatcgaaccggatgcgctggcgacgggcgagaaaagtgaatttgtgattaatcaaggcgaggcaacaggtggcagatcgtaatttgcgcgacctactcgctccgtgggtaccagcactgcctgcgagagcacttcgggaaatgacactcgacagccgcgtggcggcgtcgggcgatctctttgtggccgttgttggtcatcagacggacgggcgtcgttatatcccgcaggcgattgcccagggtgttgccgccatcatcgccgaagcgcagggtgaagccaccgacggtgagatccgcgagatgcacggcgtgccggtcatctacctgagccagcttaacgagcgcctctctgcgctggcgggccgtttttacaatgagccgtcagatcgtttacgcctgattggcgtgaccggcaccaatggcaaaaccaccaccacgcagcttattgcgcagtggggccagctgctcggcgaaaccagcgccgtgatgggcaccgtcggtaacggtttactgggcaacgttattcctactgaaaacaccaccggctccgccgttgatgtgcagcatgtgattgccggactggcagagcagggcgcgaccctggcggcaatggaagtctcttcccacggtctgatccagcaccgcgtggcggcgctcaaattccgcgccagtgtctttaccaatttaagccgcgatcaccttgattatcatggtgatatggaaaactacgaagcggcaaaatggctgctgttttccgcgcatcattatggcgaagccattgtgaacgccgatgatgaagtgggccgccgctggctggcaaaactgccggacgcggttgccgtttcgatggaagatcacatcaacccggactgccatggtcgctggttaaaagcgaccgacgtcaactatcacgacagcggcgcgaccatccgttttgactcctcctggggcgaaggcgagatcgagagccgtctgatgggcgcctttaacgtcagcaatttactgctggcgctggccaccctgctggcgctggatttcccgttaagcgatctgctgaaaaccgccgcgcgcctgcaaccggtttgcggccgtatggaagtgttcagcgcgccgggtaaaccgacggtggtggtggattacgcgcacacaccggatgcgctggaaaaagccttacaggcggcgcgcctgcactgcaccggcaaactatggtgcgtgtttggctgcggcggcgatcgcgataaaggtaaacgtccactcatgggggccattgccgaagagttcgccgacatcgccgtagtgaccgacgacaacccgcgtaccgaagagccgcgcgccattatcaacgatattctggccggtatgctggacgcaggccatgcccgcgtagtggaaggccgtgcggaagcagtgaccaacgccattatgcaggccaaagagaatgacgtggtgctgctggcgggcaaaggacatgaagattatcagattatcggcaccaaccgtctggattactcggatcgcgtgaccgccgctcgtctgctgggagtggtcgcatgatcagcgtgaatttaagccagcttgccgggatcctgaaaggcgaactgatcggttcggatctgactatcgatgcggtgacgaccgatacgcgtaaactgacgcccggctgcctgtttgtggccctgaaaggcgaacgtttcgacgctcacgattttgccgcgaccgctaaagaaggcggcgcgggcgcgctgctggtcagccgcaaagtggagtgcgatttaccgcagctgctggtgaaagacacccgtttagcctttggcgaactggcggcctgggtgcgtcagcaggtgccgacgcgcgtcgtggcgctgaccggttcctccggcaaaacctcggtcaaagagatgaccgcggcgatcctcagccagtgcggaaacacactttataccgccggcaacctaaataatgacatcggcgtgccgatgacattgctgcgtctgacgccggagcatgaatttgcggtgatcgaactgggtgccaaccaccagggcgaaatcgcctggaccgtgagtctgacccgcccggaagcggcgctggtgaacaacctcgcggcggcacatctggaaggtttcggatcgctggccggggtggcgaaggctaaaggtgagatcttcaccggcctgccgcaaaacggcatagcgatcatgaacgcggataataacgactggcttaactggcagagcgtgattggcgatcgtaaaacctggcgtttttccccgaatgccgccaacagcgattttaccgccaccaatatccatgtgacctcccacggcacggaattcaccctgcaaacgccgaccggcaatgtcgaggtgctgctgccgctgcctggccgtcataacatcgctaacgcgctggccgcgacggcattgtctatggcagtgggcgcaaccctggacgcggtgaaaaccgggctggcgcagctgaaagccgtaccggggcgtttgttcccgattgcgctgggggaaaaccagctgctgctggatgactcctataacgccaacgtcggttccatgaccgccgccgcgcaggtgctgtctgaaatgccgggctaccgcgtgatggtggtgggcgatatggcggaactgggcgcagaaagcgaagaatgtcatgcgcaggtcggcgccgccgcgaaagccgcaggcctggatcgggtactgagcgtaggcacagcaagtaaaacccttagcgacgccagcggtgtgggcgagcattttaacgataagtctgccgtcgtgacgcgtctgaaagcgctgatcgcagaacatcaaattatcaccattctggtgaaaggttcacgtagtgctgccatggaagaggtagtacacgcattacaggagaacgggacatgttagtgtggctggccgagcatctggtcaaatattattctggctttaacgtcttttcttatctgacgtttcgcgccattgtcagcctgctgaccgcgctgttcatctcgctgtggatgggcccgcgcatgattgcccgtctgcaaaaactcgcttttggccaggtcgtccgtaacgacggtccggaatcgcacttcagtaaacgcggtacgccaaccatgggcgggatcatgatcctgaccgcgattgtcatttccgtcctgctgtgggcctatccctccaacccttacgtctggtgcgtactggtggtgctggtcggctacggcatcatcggctttgtggatgattaccgcaaagtggtgcgtaaagacaccaaagggctgattgcccgctggaagtatttctggatgtcggtgatcgcgctgggcgtggcgttcgcgctctatctcgccggtaacgatacgccagccacgcagctggtagtgccgttctttaaggacgtgatgccgcagctggggctgttctacgtgctgctggcctacttcgtgattgtcggtaccggcaacgcggtcaacctgactgacggtctggatggccttgccattatgccgacggtgtttgtcgccgggggctttgcgctggtggcctgggcgtccggtaacatgaatttcgccaactatctgcacatcccttacctgcgtcatgcgggtgaactggtgatcgtctgtacggccatcgtcggcgcaggactcggtttcttatggttcaacacctatccggcgcaggtctttatgggcgacgtcggctcgctggcgctgggcggcgcgctgggcattatcgccgtgctgctgcgtcaggaattcctgctggtgatcatgggcggcgtctttgtggtggaaaccctgtcggtgatcctccaggtcggctcgtttaaactgcgcggccagcggatcttccgcatggcgccgatccatcaccattacgaactgaaaggctggccggagccgcgcgtgattgtgcgcttctggattatttcgctgatgctggtcctcatcggactggcaacgctgaaggtgcgttaatcatggcagattaccagggcaaaaaagtcgtcatcatcgggttaggtttaaccggcctgtcctgcgtggactttttccttgcgcgcggcgttaacccgcgggtaatggacacgcgcgttgcgccgccggggctggacaagctgccggaaacggtggagcgccatcttggtagtctgaatgacgactggctgctggccgccgatctgattgtcgccagtccgggtatggcgctggcgcatccgtccctcagcgccgccgccgatgaaggcgtggagattatcggcgacatcgaactgttttgccgtgaagcccaggcaccgatcgtcgccattaccggttcaaacggaaaaagcaccgtcaccaccctggtgggcgaaatggcgaaagctgcgggtatgaacgttggcgtcggcggcaatatcggcctgcctgcgctgatgctgctggacagcgcctgtgaactgtatgtactggaactgtcgagcttccagctggaaactaccaccagcctgcgcagcgtggcggcgacgatcctgaacgtcactgaagatcatatggatcgctatccgtttggcctccagcagtatcgtgcggcgaaattgcgcgtctatgaaaacgccaaagtctgcgtggtgaatgccgatgatgcgctgaccatgccggtgcgcggcgctgatgaacgctgcatcagcttcggcgtggatgtgggcgactatcacctgaaccgccagcagggggaaacctggctgcgcgtgaagggcgaaaaggtgctgaacgtaaaagagatgaagcttacggggcagcataactacaccaatgcgctggcggcgctggcgctggcggatgccgccggtataccgcgcgccagcagcctgaaagcgctaaccaccttcaccggtctcgcgcaccgtttccagctggcccttgagcataacggcgtgcgctggatcaacgactccaaagccaccaacgtcggcagcaccgaagcggcgctgaacggcctgcaggtggacggcaccttacatttactgctcggcggcgacggcaaatccgccgatttctcgccgctggcgcgttatctgaccggcgatcgtgttcgcctgtactgctttggccgcgacggcgctgaacttgccgcgctgcgtccggacattgccgtgcaaacggaaaccatggaacaggcgatgcgcctgatcgcgccgcaggtaaaagccggggacatggtgttgctgtcgcccgcctgcgccagtctcgatcagtttaagaatttcgaacaacggggcgatctctttacccgtctggcgagggagttaggctgatgcgtttatcgctaccgcgccttcgactgccgcgcctgccggggatgggtatccttggctgggctggctcggcacttcgtggctgggtcatgggatcccgtgagaaagacaccgacagtctgatcatgtatgaccgcatgctgctgtggctgacgcttggcctgggtgcggtaggttttatcatggtgacctcggcgtcgatgccggtcggccagcgcctgactaacgatccgttcttcttcgccaaacgtgacgcgctgtacctgttcctcgcgttttgtctggcggtgatcaccctgcgtctgccgatgaccttctggcagcgctacagctcggcgatgctgatcctcgccattatcatgctgctgctggttctggtggtgggcagctcgatcaacggggcatcgcgctggatcgatttagggctgatgcgtttccagcccgcggaatttaccaagctatcgctgttctgctatctggcgaactacctggtgcgtaaggttgatgaggtgcgaaataacctgcgcggcttcttaaaaccgatgggcgtgatcctcgtgctggcggtgttactgctggcgcagcctgacctcggtacggtggtggtgctctttgtcaccacgctggcgatgctgtttctggcgggcgccaagctgtggcagttcatcgccattatcggcatgggcatctccgcggtggtgctgctgatcctcgccgaaccctatcgtatccgccgcgtgacctctttctggcgtccgtgggacgatccgttcggcagcggttaccagcttacgcagtcgctgatggcgtttggtcgcggcgaattgtgggggcaggggctggggaattcggtacagaaactggaatatctgcccgaagcgcatactgactttatcttcgccattattggtgaggaactgggttatatcggtgtggtactggcgcttttgatggtattcttcgtcgctttccgcgccatgtccatcggtcgcaaggcgctggagatcgatcagcgtttttccggctttctggcctgttcgatcggcgtctggtttagcttccaggcgctggttaacgtcggtgcggcggcgggtatgctgccaaccaagggtctgacgctaccgctgatcagttacggtggttccagtctgttgattatgtcgacggcgatcatgctgctgttacgtattgattatgaaactcgtctggaaaaagcccaggcgtttacacgaggtgttcgatgagtgttcaggcgaagcgattaatggtgatggctggcggtaccggtggacacgtgttccccgggctggcggttgcgcatcatttaatggctgagggctggcaggttcgctggctgggcaccgccgaccgaatggaagcggatttagtgccgaaacacggcattgagatcgattttatccgtatttccggcctgcgcgggaaaggcgtgaaagccctgctgctggcgccgctgcgaattttcaacgcctggcgtcaggcgcgcgcaatcatgaagcgctttcgcccggacgtggtgctggggatgggcggttatgtgtcaggccctggtgggctggcggcgtggtcgctgggcattcccgtggtgctgcatgagcagaacggcatcgctggcctgaccaacaagtggctggcgaaaatcgccagaacggtgatgcaggcgtttcccggtgcctttgccaatgcagaggtggtcggcaacccggtgcgtactgatgtcctggcgctgccgctgccgcaggatcgccttgcaggccgtgaagggccggtgcgcgtgctggtggtgggcggctcccagggcgcgcgcattctgaaccagaccatgccgcaggtcgccgcgaagctcgctgaccgcgtcaccatctggcatcagagcggcaaaggcgcgcagcagaccgtcgaacaggcgtatgcggaaaacggtcaaccgcagcacaaagtgaccgaatttattgacgacatggccgccgcttacgcctgggccgatgtcgtggtctgccgttccggcgcgttgaccgtaagcgaaattgccgccgccggtttaccggcgttgtttgtacccttccagcacaaagatcggcagcagtactggaatgccctgccgcttgaaaaagcgagcgcggcaaagatcctcgaacagccgcagtttaccgtcgatgccgtggcagagacgctggcgggctgggatcgcagaacattattaatgatggcagagcgcgcacgtgccgccgccataccggatgcaaccgatcgggttgccagagcagtatgccttgcagcacaggcataaagatcgcgacgccttttgcgtcgcacgaatttttgaagtcgatggcgtttagagaatgaatacacaacaactggcgaaactgcgttctatcgtgcccgagatgcgtcgcgtccggcacattcactttgttggcattggcggtgccggtatgggcggtatcgctgaagtgctggccaacgaaggctatcagatcagcggctccgatctggcgcccaatccggtgacgcagcagttgtcttccctcggcgcgaccatttatttcaatcaccgtccggaaaacgtgctggatgccagcgtggtggtggtgtcgagcgccattaccgcggataacccggagatcgtcgccgctcatgaagcgcgcattccggtgatccgccgcgctgaaatgctggcggagttaatgcgttttcgtcacggtatcgccatcgccggtacgcacggtaaaaccaccaccacggcgatggtggccagtatttatgcggaagcagggctggatccgaccttcgttaacggcggtctggtgaaagcggcgggcgtgcatgcgcgtctgggtcacagccgttatctcatcgccgaggcggatgagagcgatgcctctttcctgcatttgcagccgatggtggcgattgtcaccaatatcgaagccgatcatatggatacctaccagggcgacttcgaaaatttaaagcagacgttcattaattttctgcacaacctgccgttttatggccgtgcggtgatgtgcgtggacgatggcgtgatccgtgaactgctgccgcgtgtgggacgtcagacgaccacttatggcttcagcgatgatgcggatgtacgcatcgaaaattatcgccagaccgggccgcagggtcactttacgctgctgcgtcaggacaagcctgcgctgcacgtaacgctgaacgcgccgggtcgccataacgcactgaacgcagcggcggcggtagcggtcgctacagaagagggtatcgacgatgcggcgatcctgcgcgcgctggaaagtttccagggcaccggccgtcgtttcgatttcctcggtgaattcccgttagaaacggtgaacgggaaagcaggcaccgcgatgctggttgatgattacggtcatcacccgacggaagtggacgccacgatcaaagcggcgcgcgcgggctggccggaaaaaaatctgatcatgatcttccagccgcaccgctatacccgtacccgcgatctgtatgacgatttcgccaacgtgctgacgcaggtggataccctgctgatgctggatgtgtattccgccggcgaaacgccgatcccgggcgcagacagccgttcgctttgccgtaccattcgtggtcgcggtaaaatcgacccgatccttgtgccggatcacgcgcaggtggcggcgatgctggcgccggtattaaccggcaacgatctgattctggtgcagggcgcaggcaatatcggcaaaattgcccgcagccttgctgaaagtaaactgaaaccgcaaacccaggaggaagaacatcatggctgagaaagttgccgtcctctttggcggaacctctgcggaacgtgacgtatcgctgaattccggcgcggcagtgctggccggtctgcgcgaagggggcgttgatgcccatcctgttgatccgcgcgataccgatgtcacgcagttaaaagcgctcggctatcagaaagtgtttattgccctgcacggtcgcgggggagaagatggcacgttacagggattgctggagctgatcgggctgccttataccggcagcggcgtgatggcgtcggcgatctccatggacaaactgcgcagcaaattgttgtggcagggcgcgggtttaccggtcgcgccctgggtggcgctaacccgtaaggccttcgaagcgggtcttgatgacgccgttacggcacagatttccgcgctgggcttaccgctgattgtgaagccgagccgcgagggctccagcgtgggcatgtcaaaagtcaccgaagccagtgcattacaggatgcattgacaatggcttttcaacatgatgaagatgttcttattgaaaaatggctcagtggcccggaatttacgctggccgtgctcggtgaagaaattttaccgtcaattcgcatccaacccgctggaaccttctatgattatgaggcgaagtatctctctgatgagacacaatatttctgtccttccggtttagaagcaggcgatgaatcgcatttacgcgatctggtgcaaaaagcatggaccgcgttaggctgtcagggctggggtcgcattgacgccatgcaggacagcgatggccagttttatctcctggaagcgaatacctcgccgggcatgaccagccatagtctggtgccgatggcggcgcgccaggcgggaatgagcttctcgcagctggttgtaagaattttggcattggcggactgatatgtcgcaggcggcactgaacacgcgcaaccagagtgaggaagacgttagctcctcacgacggaataatggaacgcgtctggcagggattattttcctgcttacggtagtgtgtaccgtgctggtgagcggctggatggtgctgggctggatggatgacgcgcaacgtttacccctttccagactggtagtcacgggcgaacggcattacacgcgtaatgatgatattcgtcagtccatactggcgctgggatcgcccggcacctttatgacgcaggacgtcaacatcattcagagccagatcgagcgcctgccgtggatcaaacaggcgagcgttcgtaagcaatggcccgatgaattgaagattcatctggttgaatatgtgcctatagcgcggtggaatgatcagcacatggtggatgccgacggcaattcgttcagcgtacctgcggatcgcgtcagtaaagagggattacctctgctgtacggtcccgaaggcagcgaaaacgaagttttgcagggctaccgtgatatgggtaaagagctggctaaggataagttcacgttgaaagaggcggccatgaccgcgcggcgctcctggcaattaacgttgaacaacgatattaagctcaatcttgggcggggcgatacgatgaaacgcctgtcccgctttgttgaactgtacccggtgcttttgcagcaggcgcagaccgatggcaaagagattagctacgttgacttgcgctatgactcaggcgcggcggtcggatggaaaccggctcccattgaggatcctaatcagcaacagaatcaggcacaggcagagcaacaatgatcaaggcgacggacagaaaactggtagttggactggagattggcaccgcgaaggtcgccgctttagtaggggaagttctgcccgacggtatgatcaatatcattggcgtgggcagctgcccgtcccgtggtatggataaaggtggggttaatgacctggagtccgtggttaaatgcgtacagcgcgccattgaccaggccgaattaatggcagactgccagatttcgtcagtgtatctggcgctttcaggtaaacacatcagctgccagaatgaaattggtatggtgccgatttcagaagaagaagtgacgcaggaagacgttgaaaacgtggtgcataccgccaaatccgtgcgtgtgcgcgatgagcatcgcgtcctgcatgtaattccgcaggagtacgccattgattaccaggaagggatcaagaacccggtgggtctgtcgggcgtgcgtatgcaggcaaaagtgcacttgatcacatgtcacaacgatatggcgaaaaacattgtcaaagccgttgaacgttgtggcctgaaagttgaccaactgatctttgccggactggcgtccagttattctgtgctgacagaagacgaacgtgagctgggtgtctgcgttgtagacgtcggcggtggtacaatggatattgccgtctataccggtggggcgttacgtcacacaaaagtgatcccttatgcggggaacgtcgtcaccagcgatatcgcctatgccttcggtacgccgccgagcgatgccgaagccatcaaagtgcgccatggctgcgcactcggctctatcgtcggtaaagacgagagcgtagaagtaccgagcgtgggcggtcgtccgccgcgcagcctccagcgtcagacgctggcggaagtgattgagccgcggtataccgaactgctcaatctggtaaacgaagagattttacagttgcaggagcagcttcgtcagcagggtgtgaaacatcatctggcggcggggattgtgttaacaggcggtgccgcgcagattgaaggcttagccgcctgcgcacagcgagtgttccatacgcaggtgcgtattggtgcgccgctcaatattaccggacttacggattacgcccaggagccgtattattccacggcggttgggttgcttcactacgggaaagagtcccatttgagtggtgaagcagaagtggaaaaacgtgtgtcagtcggctcgtggatcaaacgactcaacagctggctgcgaaaagagttttaatttttcagagaccggagaatattagcggtctcaggcgacaggcacaaaacggagagaaattatgtttgaacctatggaactgaccaacgacgcggtgattaaagtcatcggcgtcggtggtggcggcggtaacgccgtcgaacacatggtgcgcgaacgcatcgaaggtgtggaattcttcgcggtgaatactgacgctcaggcgttgcgtaaaactgcggtgggtcaaaccattcagattggcggcggcatcaccaaaggtctgggagcaggcgctaacccggaagtcggtcgcaatgcggcagaagaagatcgtgaagcactgcgtgcggcgctggatggcgcagacatggtgtttatcgcagcgggcatgggcggcggtaccggtaccggtgcagcgccagtcgtcgctgaagtagcaaaagatttgggtattctgaccgttgctgtcgtgaccaagcctttcaatttcgaaggcaagaagcgtatggcgtttgcggagcagggtatcactgagctgtccaagcatgtggattcgctgatcaccattcctaacgacaaactgctgaaagtgctggggcgcggtatctccctgctggatgcgtttggcgcggcgaatgacgtgttaaaaggcgcagtgcagggtatcgctgagctgatcacccgtccgggcctgatgaacgtcgactttgctgacgtgcgcaccgtaatgtccgaaatgggctatgcgatgatgggctccggcgtagccagcggtgaagaccgtgcggaagaagcggcagaaatggcgatctcctccccactgctggaagatatcgatctgtccggtgcgcgcggcgtgctggttaacatcaccgccggcttcgacctgcgtctggatgagttcgaaaccgtgggtaacaccattcgtgccttcgcttccgataacgcgaccgtggtaattggtacgtcgctggatccggaaatgaacgacgaactgcgcgtgactgtggtggcgaccggtatcggcatggacaaacgtccggaaattacgctggtgaccaacaagcagacgcagcaaccggccctggatcgttaccagcagcacggcatggcgccgttgacgcaggaacaaaaaccggcagcaaaagtggttaacgacaatacgccgcagaccaccaaagagccggattatctggatatcccggcatttttgcgtaaacaggctgattaagaattggctggaagttgggcatctccgctctttgtgctaaactggcccaccggttgtgtagtacaatctggttggataggtaattaggcgagataatacgatgatcaaacaaaggactcttaaacgtatcgttcaggcgactggcgtcggtttacataccggcaagaaagtcacactgacgctacgccctgcgccggcaaacaccggggtcatctatcgtcgcaccgacttgaatccaccggtagatttcccggctgatgccaaatctgtgcgtgataccatgctctgtacttgcctggtcaatgagcatgacgtacgaatttctaccgtagagcaccttaacgccgctctggcgggtctgggtatcgacaacatcatgattgaagtcgacgcgccagaaatcccgatcatggacggtagtgccgcgccgttcgtttacctgctacttgatgctggtatcgaagagcttaactgcgcgaagaaattcgttcgcattaaagagacagttcgcgttgaagatggcgataaatgggctgaatttaaaccgtacaatggtttctcgttggactttaccatcgacttcaaccatccggcgattgactccagcaaccagcgctatgcaatgaacttctctgccgatgcgttcatgcgtcagatcagccgtgcgcgtactttcggcttcatgcgtgatatcgaatatctgcaatcccgtggtttgtgcctgggcggtagtttcgattgtgccatcgtcgttgacgattatcgcgtactgaacgaagacggtctgcgttttgaagacgaattcgtacgtcacaaaatgctggatgcgattggcgacctgtttatgtgtggtcacaatatcatcggcgcatttaccgcgtacaaatccggtcacgcactgaacaacaaactgttgcaggcagtcctggcaaaacaggaagcctgggaatatgttacgttccaggacgaggcagaaatgccgctggcgttcaaagcaccgacaatggttctggcgtaacagtccataccattattaaaattcggctggcaaacctggcactctctccggtcaggggtgtcagccgtttttgtttttaaatcacggtattccgcttcttctgcccgcccgttactcctcttacggttttcagcatttttcctggtgcgttcggtgttttcttaagcagttttacctcttccacgccttcattactgctgtcctgtcacgccattagtggtaatatttgggcgcacaaaaacgaatacacaaataaacctgtgcaggtttgcatcattcaggtgaggtaagtgagcggattactgacgcgctggcgacaatttggcagacgctacttctggccgcatctcttgttagggatggtcgcggcgagtctcggcctccccacgctcaataacaacgctgacgccgcgcaacccgccagaaccgctgccagtaatcacgatcgcatcactccggttaacttcaccagccttgcgctgctggaagcaaaccgccgacccagttttaccgtggattactggcatcagcacgcgatccgcacggttatccgccatctctcttttgctatggcgccgcagacgctgtccgtcgcggaagcgccattgcctggcgaggcgcaccaccgcgcgctgctggatacgctcaatgccttactgacgctggagagaaaacctccggtcattgttcgtcagtacatcactgcctcatcgttctccccgacggcgtttaacgtctctgcctggctgagccaggtgcaggggatccgcgccggacctcaacgcctcagctgatcttttctggtgttttcctttttattagactccgcgaagcggggcgtttgagatttttattatgctaatcaaattattaacaaaagtttttggtagtcgtaacgaccgtaccctgcgccgtatgcgtaaagtggtgggtgtcattaacagcatggaaccggcgatggaaaagctcaccgacgatgagctgaaagcgaaaaccggtgaattccgtgcgcgtctggaaaagggcgaaaccgttgaaagcctgatcccggaagcctttgcggtggtgcgcgaagccagtaaacgcgtgttcggtatgcgtcactttgacgtacagctgctgggcggcatggtgctgaacgaacgctgcatcgccgagatgcgtaccggtgaaggtaaaactctgaccgcaaccctgcccgcttacctgaacgccctgagcggtaaaggcgtgcacgtggttaccgtcaacgactatctggcgcagcgtgacgccgaaaacaaccgtccactgtttgagttcctcggcctgacggtgggcatcaacctgcctaatatgcccgctccggcgaagcgcgaagcttatgccgctgacatcacctacggtaccaacaacgaatacggctttgactacctgcgcgataatatggccttcagccctgaagagcgagtgcagcgtaagcttcactacgcgctggtggatgaggtggactccatccttatcgatgaagcccgtacgccgctgatcatttccggcccggctgaagacagctctgaaatgtacatgcgcgtcaacaaaatcattcctaacctgatccgtcaggaaaaagaagactccgacaccttccagggtgaaggtcacttctcggtggacgaaaaatcccgccaggtgaacatcaccgagcgcggtctggtgctggtggaagagctgctggtcaaagaaggcattatggaagagggcgagtcactgtactctccggccaacatcatgctgatgcaccacgttaccgctgcgctgcgtgcgcacgtgctctttacccgtgacgttgactacatcgtgaaagacggcgaagtcatcatcgttgatgagcacaccgggcgtaccatgcagggccgtcgctggtctgatggtctgcaccaggcggttgaagccaaagaaggcgtgcaaatccagaacgagaaccagacgctggcgtccatcaccttccagaactatttccgcctgtatgaaaaactggccggtatgaccggtaccgcggacaccgaagccttcgaattcagctctatctataagctggatacggtggtggtgccgaccaaccgtccgatgatccgtaaagatatgccggatctggtctacatgaccgaagcggaaaaaattcaggccattatcgaagatattaaagagcgtaccgccaaaggccagccggtgctggtgggtactatctccattgagaaatcagaagtggtgtctcaggaactggaaaaagcgggtatcaagcacaacgtgctgaacgccaagttccacgccaacgaagcggccatcgtcgcacaggcgggttatccgtcagcggtgaccatcgccaccaacatggcgggtcgtggtacggatatcgtgctgggcggtagctggcaggcagagcttgctgaacttgaagatccaaccccggagcagatcgcgcagattaaagccgactggcaggcgcgtcacgatgccgtgctggcgtccggcggtctgcacatcatcggtaccgaacgtcacgaatcccgtcgtatcgataaccagctgcgtggccgttctggtcgtcagggcgatgcaggttcttcacgcttctacctgtcgatggaagatgcgctgatgcgtatttttgcctctgaccgtgtgtcgggcatgatgcgtaaactgggtatgaagccgggcgaagctatcgaacacccgtgggtgaccaaagctattgccaacgctcagcgtaaagtggaaagccgtaacttcgatattcgtaagcagctgctggaatatgatgatgtggcgaacgatcagcgtcgtgcgatttacacccagcgtaacgaactgctggacgtgtccgacgtaagcgaaaccatcaacagcatccgcgaagatgtcttcaaggcaaccatcgatgcgcacattccgccgcagtcgctggaagaaatgtgggacatccctggtctgcaggaacgtctgaaaaacgatttcgatctggaactgccgattgccgagtggctggataaagagccagagctgcacgaagaaaccctgcgcgagcgtattctgactcaggcggttgaagtctacaaacgcaaagaagagatcgtgggcgcggagatgatgcgccacttcgaaaaaggcgtgatgctgcaaacgctggattccctgtggaaagagcaccttgcggccatggattatctgcgtcagggtattcacctgcgcggttatgcgcagaaagatccgaagcaggaatacaagcgtgaatccttcgccatgttcgcggcgatgctcgaatccctgaagtacgaagtgatcagcaccctgagcaaggtgcaggtgcgcgaaccggaagaagtggaagagatggagcagcagcgtcgtcaggaagctgaacgtctggcgcagatgcaacagctcagccaccagaccgacgaagctgaagccgcagaagcgctggccgcacagaccggcgaacgcaaagtgggtcgtaacgatccctgcccgtgcggttccggtaagaaattcaaacagtgtcatggccgtctgaactgatcctgtcacgaccaccacaaaaggcgcagatatctgcgccttttttatggagcgaaatgaatgaaagtactgcatatttctgccggcatcatccgcaatgcgcagggtgaaatctttattacccagcgcgctgccgacgcgcatatggcaaacaaaaaagagtttcccggcggcaaaatcgaagcgggtgaaaccccggagcaggcgctggtgcgcgagctggaagaagaggtggggattgtcgtcaccagcgcgcagctgtacgagcggctggagtacagctacccggaactgcatattacgctgtggttctatctggtggaaagctgggaaggcgaaccctggggcagggaaggtcaaccgggcggctggatagcgcagcaggcgctgaatgcggacgatttcccgcccgcgaacgcgcctatcgtcacccggttacaccaggaactttagggcttctcttcgctccagtcgtcgctgtcattaagctcgccggagctcgggatgcgtttttcttctgcggcccactcgccgagatcgatcagctggcagcgtttagaacaaaacgggcgaaacgggctgacgtcgccccagacaacttttttcccgcaggtcgggcagtttacgatcataacttcagacatatcagttccttaacagcaggccagttcaaaatccagacgctcagggatcacgccattttcactgtccagcggcaggaagcgaatggcgaagcggcttttatggccggaaatttgcggatagagcgcatccgacagcgcaagttgcagacgcagtaaatcggcatcctcgccgttatcctggtaaaaaccatgcaggctggtctgcttacggaatggcgcggaattacgcactaattcgaggatcagggttaacgtctgggtcaggggctgcaggctgttaagccagacgctgacctgctcatcccgttgcgcctggggtaaatgcagccacaggtgcagcgtcggcaaatcaaagctacagcagccgccgggaatgctcagacgctggcgaaccaggccaatgagtttatcttcacgcaataactggccgatgcgcggggccgacatcagcgtcgtgctgcactgtctgagctgatcgctgagagcggcgatccgctcctgatccacgcccggcacttcgacccaggctttaagtttacgctgctggcgctccagctcttttaacaattctgtgcgtacttccccgcgttcgaacacatccagcaggtcgccgatattacggaaaaaatgcagcgcgtcggtggaatcagcgatgggtaaacggcatgacagctgctggaccaaaaattcaatgcgcaaccaggtgcgcattttttcattaagcggatgttcaaagaggacatgggtgtgcattacgctttttcctgtgaaacggcccgggcggcgtagctaaggtacgcggcatgcaggcgggcaacatccgatgccacggcatctggtgcgccattattgtcaataatatcgtcagcgatggccaggcgagcttcccgcgtcgcctgcgcggcgagtatatgttcggcatgttcgcgtgttacgccatcgcgctgcatggtgcgagagagttgtatttcaggcgagacgtccaccaccagcacccgatcggctttggtatgtaactggttttccaccagtaacggaacgacccataagacataaggggatgtcgcctgggcaatctggcgctgggtttcctgatgaattaaaggatgcagtaaggcgttaagccaggctttttctgccggggaggaaaaaatgcgttcgcgcagcacgcgacgatttaacgtcccgtctgcgttaatcaccgtatcgccgaagtgctcgccgatggcagccagcgcgggcgtacccggttccaccacctggcgggcgataacatcagcgtctactacgttaaccccacagcgggagaaagcgtttgcgacagtggttttgccactgccaatacccccggttaaggcgaccgtataccccataaaacaaaatcccaaaatggtcagccagacgacgaccggtcaatttatttgtttcgtaaatcaatcggttataattcgtacagaaaacggggcgtcagatgcggcgaaactgagccgttttccaggtaaatttataggattgtagcgtaaaaaaagagaatttcgcagtcttgcgcagacctatttagtgcgtatgatagcgtcactggagttgtgtgtttgacagtatgcttttatcgccattaaccccaggacccctacatgcgtatcgaagaagatttgaagttaggtttcaaagacgtccttatccgccctaaacgttctaccctcaaaagccgttccgacgttgaactgggacgcgaattcacctttaagcattcaggtatggcctggtcaggggtgccgattattgccgccaatatggataccgtcggcaccttcgcgatggcaaaagcactggcttcattcgacatcctgacggcagtacataaacactattccgtagccgactggcaggcgttcgttgcgcgtgaatccgacgcggtgttaaaacacgtgatggtgtccaccggcacttctgatgcggatttcgacaaaacccgccagatccttgccctgaatccggccctgaactttatttgcattgacgtggcaaatggttactccgaacacttctcgcagtttgtgaccaaagcgcgtgaagcctggcccaataaaaccatctgcgcgggcaacgtggtgaccggcgaaatgtgtgaagagctgatcctttgcggcgcggatattgtcaaagtaggcattggccccggctccgtgtgtaccacccgagtgaaaaccggcgttggctacccgcaactttccgcagtgatcgaatgtgccgatgcggcgcacggtctgggcgggcaaatcgtcagcgatggcggctgcaccgtaccgggcgatgtggcgaaagctttcggcggcggcgcagatttcgtgatgctcggcggtatgctggcgggacacgatgaaagcggcggtaccgttgttgaagaagacggtgacaaattcatgctgttctacggcatgagctctgaatccgccatgaatcgtcatgtcggcggcgtagcgggttaccgtgcagccgaaggtaaaaccgtgaagctgccgctgcgtggcccggttgaaaataccgcccgcgatatcctcggcggtctgcgttctgcctgcacctatgtgggcgcgtcccgtctgaaagagctgaccaaacgcaccaccttcatccgcgtggcggagcaagagaaccgcgtgttcaacagtctctgatgcctttgctggcgcggttcgctgcgccagccttatctatcccattccgctcattgcatcccccagatgaaacaccggcagatacatggccaccaccagcgtaccaataattaaccccgtcactatcagcatgatcggctccagcagtgcggccaggttatccgccagctgctgcgtcttttcgctgtgatagcgcgccagatcgccgagcatggtatccagcgcccccgacgcttcgccggttctgaccagctgtacgcagagcggggtaaattcaccgctgttcttcagcgcctgccagataggtgcgccatgggtgatctcatgatgcgcctgatgcagcaggtcacgccagtacgggcagggcagcgtattttccacactctccagcccctgcaaaaaggcgataccggcgttttgcgtaagcatcagcacggtaaaaatctggctgagcttttgcccgcgcaggagtgcgcccaccaccggacaccgcagcaacaggcgctgacgatagcgcaaccagcgcggctttttacgcagcttatacagggtaagaatcagcgcgataaacagtaccagcaccgccgcgccccactggtgtataccgtccgccagcgccatcacgccgcgcgttaacgccggcagcggcgcgttaaaggtgcggtagatggcggcgaactccggcagcaccaggtaaaccattgccagcacaatcagcaccgccagcgataagacgatcagcggatagcgcagtgcctttttaaccttcgccgccagcagccgctgcgccttttgccgggccgccagttcaaaacaacagctatcgagtttacccgtcagttcaccggtgtggatcagggcaacatacagcgggggaaaggcctgcggccactgctggatcgccgccgaaaacggcgtgccctgttccagctcctccgccaggtgttgcagcagcgcctgccactgggggcgcggatgctgtccggctaaaagccgtaacccatccggcaacgccagccccgcctgcaacagggtcgccagctggcggatcacctcctcgctgtgcgttccccgccaggcgcgcgcatgcaccggacagcgtttaagctgtaagaggtgcacagcgcggtgctgtaaggccatcgccacgctgacccggtcctcaccccacagcagcccctcgcgtggatgtcccgcctgatccagcccgcgccactgccacagggtattagtcggcatggggaatacccagtacgcgcagcagctcttcctgcgtggtcagtccgcgctcgacggccagacagccgctctcgaacagcgtggtcattccggcctgccgcgctttgcgatgaatgtcgctggccgtatcccccgcggcgatggcatgccgcagcggcttgtttaccggcagcacctcaaacagcgcgatcctgccgtaaaaaccgtgatagcactggtcgcagccagtggactgccatcgtggtaacgggcgcggccacagcgctggcgggatcagcgtgtcgctctggatttttgaccggcagtgcgggcagagtttgcgcaccagccgttgcgccaccaccagcgaaagcgccgaggcgagcatccatggcgcaacgcccatttgctggatgcgcgtcagggtttcgctggtggagttggtgtgcagcgtcgacagcaccagatgcccggtctgcgaggctttaatagcgatttccgccgtttcgccatcgcggatctcaccaaccatgacgatatccggatcctgacgcagcagcgcgcgcagtacgctctgaaagctcaggcccgcacgtggattgatttgcgtctgattaagtcccgccagcgggatttcaacaggatcttccacgctgcaaatattcacctcatcgctgttacgcgactgtaaggcgctgtagagcgtcaccgttttaccgctgccggtaggcccggtcaccagcagcaggccctggggtttgctgagcgcggtctgaaactgcgccagctgttccggcagcatgcccagttgcgtcagctccagcgtctgattgacctgatgcagcagacgcagaacaactttttcaccgtagcggcagggcagggtggcaatgcgaaacgaaatggctttaccgttgagtgttacggtaaactgcccgtcctgcggcaggcggcgctcggcaatgtcaagattgcccagtaccttaagacgcgccaccagggttttcgccatggctggcgccaccggcggcaaggtgtgcagtacgccgtccacccgcagacgaattcgaaaatcagcctcgcccggctcaaagtgaatatccgatgcccgcagcgtcagcgcctgttgcagggtatgatcgagaaacgccgttgtggtggcgctgtcctgcgtcacaacagatagctgcggcgcagagagacgctgccggtgtttttccatctcctctgccgtccagcactcaatgtcgatacgcttttgggtagcaaagcgcagcgcagccatcagatcgtcagacggctcgtttataaccgcgatagcgatgcgccgatcgttactctccagcagcagggcgttatgacgctgacataacgcgatcaactgttcctgtttcatttcgcctcctgttgaccgctgaagcgaaacacctcttcacaggcctgtttcagcgcgccatcgtcctgcaccgtgcacagccgatcccagcccgtcatgccattgctgttattccactgtggcgtgagggtaacgccaagcccggtcaggctttcctgtccggtaagcgccacgacgcctttcaccacgctcatggcggagacatagcgggtggtggtgggcgacggaatgccgttgctgcccgcatcgcagaccgccacgccgccatgatcgagggcgcacagttcaatggctgtccggtaggggatgaaggtttgcagcatgtccgtcagcgccgctttgcgcaggtagttctgataggcgggaatgctgatggcgctgaggatggaaataatgccgataaccaccattagctcaattaaggtaaatcctttttgcgtgtccataatgtgctccttgttgacctggagcgactctggcagtaacggcggggcggtgcgaggggataaaacgtatccgcgaaggcggcttcagaagattttacgcgtgttgcaatattcagcacgattattgcgagcggctacgaaaaattgcccgacgactcccgccgggcaacgcacgctatcagcgaaaacgcatcgacagatccagcgcctgcacatgcttggtcagcgcgcccacggaaatgtaatccacgccggtgtcggcaaattcgcggatcgtttctgcggtgacattgccggacacttccagccgcgcctggccgctggcgcgcttcaccgcttcgcgcatttggtcagtgtcgaagttgtcgagcatgatgatgtcggccccggctttcagcgcatcatccagctcatccagggtttccacttccacttccaccggcacgtcggggtgcagccagaaggctttttccactgcctgacggacgctgcccgcggcgataatgtggttctctttgatcaggaaggcatccgacagcccgaggcgatgattcgccccgccgccgcacagcacggcatatttcagcgcggtacgcagccccggcagggttttgcgcgtatccagcagctgcgttttggtgcccgccagcagcgcgacgtagcggctgaccacgctggcgacgccggagagcgtttgcacaaagttcagcgccgtacgctcgccggtcagcagcacgcgggacgggccgtcgagttcaaacagcgtttgattcgcggtgatggcatcgccatcggcgacatgccacgtcagggcgacatcatcgccagccagctgaataaagacttcttccacccagcgtttgccgcagaaaataccgtcttcgcgggtgatcaccacggcgtgtgcgcggtcgtctgcgggcaataattgggcggtaatatcattgttcgcatccacctctccaccgagatcttcctgcagcgcgcgcgccacagcggcaggaatgtcgaggttaatacgttctaaaagcgcgtcacgtcgatggtcggggttatagcggcgaggcggcatgataaactccaaaaagggtaacgaatcaaaagattgaaacatgctactctgaaccgtgtatcagcaccatatcttaggagatcctgcatgctgttaaacaagggctggttggtggatgctcgccatgtgccttcgccgcaccatgactgccgcccggacgatgagaccccctcgttactggttgtgcataatataagcctgccgcccggacaatttggcgggccgtggattgatgcgctgttcaccggtacgctggatccgcaagccgatcccttcttcgctgagattgcccatctgcgcgtgtcagcacattgcctgatccgtcgtgatggcgaaatcgtgcagtacgttcctttcgataaacgcgcctggcatgcgggtgtgtcttgttatgcgggccgccagcggtgcaatgatttttccatcggcatagagcttgagggaacggacaccacgccctacaccccggcgcaatatcagcagttagccgcggtgacgcaaacattgatcgggctttatccggcaattgctgacaatataaccgggcacagcgatatcgcacctgagcgtaaaaccgatcccggcccggcttttgactgggcgacatttcgtgctctggtcaccccctcgtcagataaggagatgacatgacgttgtttactatgctgttagttctgattgccgagcgcctgtttaaactcggcgagcactggcagcttgatcaccgccttgaagtgctgttccgccgcatccgccatttttcgatgttccatacgctgggtatgaccgcgctggcgatgctggcgacctttctcgtgttacgcgcgctttatggcctgttttacaacgtgccgctgctggtggtgtggatcctgctcgggctgttgtgtatcggcgcgggcaaagtacggctgcactaccatgcttatctgaaggccgcagcgcgggatgatgcccatgcgcgcggcgcaatggccagtgaactgacgatgatccacggcgtgccgccggactgcgatgagcgtgagtttttacgcgagctgcaaaatgcgctgttgtggattaacttccgcttttacctcgcgccgctgttctggtttatcgtcggcgggacatggggaccggtgacgctggtaggctatgcgtttttacgcgcctggcagtcgtggctggcacgttatatgacgccgccgcagcgccatcagtccgggattgatgccattctgcatgtgctggactggatcccggtacggctggtgggcgtggtgtatgcgctgattggtcacggtgaaaaggcgcttccggcctggtttgcgtcactttacgatcgtcatacgtcgcagtatcaggtgttgacacggctggcgcagtattcgctggcgcgtgagccgcatctggaccgcgttgaaacgccaaaagtggcggtttcaatggcgaagaaaacgtcctttgtggtggtggttgtggtggcgctgctgacgatttacgggacgctggtgtaatttttgagacgatgccgggtggcgctgtgcttacccggcctacaagatcctgcgcttacccggcctacatatcctgcgcttatccggcctacagatcctgcgcttacaagcatatgtaggcccggcaagcgaagcgccgccgggcaatcttcttaattgttatccgccggtggcaccccaaagtccggcatcccgtcctctttccagtggatcactttcagccgcgtatgacggttcggatcgtacagcggatcgccttcgatctcggtgtagttgcgcgcgtggtaaaccagcacgtcctggccgtccggcgtttgcgtaaagctgttgtgacccggcccgtactggcgattctcatagctggtcacaaagaccggctgcggggatttatgccagttttccggctgctgcgggtcggcgtcaatagcgatccacagcaggcccaggcagtaattttcatcggtggcgctggcggaatagctgataaataaccgatcgccatggaacagcaccgccgggccttcattgaccttaaagccccggcactcccagtcaaattcgggtttgcttaacatcaccggctgacccttaatcgtccagggattttccagctctgccaggtacaggtttgagttgccttcaatggccggatctttttgcgcccacaggtaccactgtttaccctgatgcttaaaggtagtggcatccaggcagaaagagtcgaactgtgttttgatctgccctttttccgtccagcgaccggtcagcggatcggtgtcggcgcactccagcacaaacatacggtgctggaacatattcagcgcatccagatcgtgggtgtgcgtggcggcaaaatagagataccacttgccgttaagatgatgcagctccggcgcccagataagctggctcatcgggccgctggcgggtttacgccagaccacgctggcaggcgcatcgcgcaatccttcgatagtggcggcgcggcggatctccagccgatcgtattccggcactgaggcgacaaaatagtaggcgttgtcgtggcgcagaataaagggatcggcgcgttgttcgataaagggattgggccacgggttcatcaggctttccttatggtttaaccggctgatgggaagcagtctcattcagctcgcgataattagtgcgacgtttctccagatcgctctggatctgtttcatggtttcacggtcgactttcaacaggcgtaccacgcccgcggtgatcaaatagcccacgcccggaatgacgctgaacagcagtacgataccgttaatggcgcttgcgctttgcgctttcgcacccgcgtcgtaaccataccaggagagcaggaagccgaccatcgccccggcaaccgccagacccactttcaggaagaacaggttgccggagaagctgatgccggtgatgcgtttaccggttttccactcgccgtagtcatccacgtccgccatcagcgaccagtgcagcggggaggggatttgatgaataacgttaagcaggaaatagagcatcacgataagcgtcgtcgcctgcggatccaggaagtaaaagccgccggagaaaatcgccagcacaatgttggtccagaagaagacctgcaatttacaccagcggtcggtcagcactttcgccagcatactgccaatcatcatgcccaccacgccgaggctgataaacagggtggcgaaatgggtgctttgtcccatgacccaggtgacgtagtacatggtggccgccatgcggatgaagcccgggcagacattgcacagggtgagcagcagaatgcgtacccactggtcgtttttccagacgtctttgaagtcttttttcagatcgtcattggtcgggacggcgggtttgacgcgctcgcgtaccgtcgcaaagcagtagaggaacatgcacatgccgataaacgccagcaccgtcatcgccatctggtagcctttggctttatcttcgccgccaaaccactccgccatcggcagcagcgtcagcgacaacagcagggtggcgatccccaccatcacaaaacggtaagactgacaggcgacgcgctcttttggatcgttggtgatcacgctgcccagcgagcagtaaggaatgttgatggcggtataggtcagcgacagcaggaagtaggtgacaaacgcatagataaccttgctgttatatgtccagtccggcgtggtaaacatcagcacgctgaacaccgcgtaaggcacggcgatccataacagccatggacgaaatcgcccatatttgctcttcgttctgtctgccagcgcgcccataatcgggtcggttacggcgtcaattacgcggatggaaagcagtaatacgcccaccagcgccggagccagaccaaatatgtccgtatagaaataattcacaaacaacatgatagcgccaaagataatattacatccggcgtctcccattccgtagccgatcttttctttgactgacagtttagcgttgtccatcgacaattctcccgttgagatatggagagaattattcgcacgctatgacttttttgcgtagcaggtttaagttaaagagatggacaaaatggctatgcaggggaaagtgtgaaccaggtaacaggggcgggtccccctcgcccgaaggagaggggggaaagcaacaagattaatgggcttttgcggttttgaggttcttctgtttgaagaagtaaccgacggcaaggatgagcatccacaccgggatcagccagacggagatcgccatgcccggggtcatcgccataatcaccagcactgccgccataaagagcaggcagatccagttacccagcggatagaacagggccgggaagcgggttttcacaccctgcaaatctttcgcgcggcggaacttcatgtgcgccaggcttatcatcgcccagttgatcaccagggccgaaaccaccagcgccatcagcaggccgaaggcttcgcccggtgccaggtagttgatcagcacgcacagcgcggtaaagagcgcagagatgaggatggtgcccaccggcacgccgcgtttatccactttcgccagcactttcggcgcgttgccctgttgcgccagaccgaacagcatacggctgttgcagtacacgcagctgttgtacaccgacagcgcggcggtcagcactacaatgttcagggcgttagccacgaaggtgtcgcccagctcatggaagatcaacacgaaggggctggtgtcggcggtcacgcgcgtccacggcagcagtgacagcagcaccgccagcgagcccacatagaagatcagaatgcggtagatcacctggttggtggctttcgggatgctgacctgcgggttatcggcttcggcggcggtaatgcccaccagctccagcccgccgaaggagaacatgatgatcgccatcatcatcaccagcccggtaaagccgttaggcaggaatccgccctgttcccagaggttgcgcacggtggcctgcgggccggcgctgtcgctgaacagcagccagccgccgaacaggatcatcgccacgaccgcgatcactttgataatggcaaaccagaactccatctcgccaaacacttttacgttggtgaggttgatagcgttgatcaccacgaagaacacggcggccgacgcccaggtcgggatctccggccaccagaattggatgtatttaccgacggcggtcagttccgccatggcgaccagtacgtacagcacccagtagttccagccggacgcgaagcccgcgaaaccgccccagtatttataggcaaaatggctgaacgaaccggctaccggctcttcaaccaccatctcgcccaactggcgcatgatcagaaaagcgataaaacctgcaatcgcatagccgagaataattcccggcccggcggactggatgactgacgcgctgcccagaaacaggccagtcccgatagctccacccagcgcaataagctgaatgtggcggtttttaagcccgcgcttcagcagttcaccgtgctgttgaccttccatcatgaaacctcgtgtgtggttattattagtacgctgttgtgtgcgtgtacggatgaaattccatttgttgtatttatatgtttacgaaaggtctttcttaaatatggcgctgagtctttcgtctgcatcagaatagtggtaagcgcatgcgaatgcacctgctttattaggggcgcatgacgactgaataaaaagaaaccaattgtaaatggtagccattcctcctcttcattaccccaaatgcataattccactccagaaatgggtatttactcgtttttcgtgcgactgaatcggttcactttaccggtcaggcgtttcacataagttaaatatgcctctttatgagtagcgggctcatttgtgcgaagttacatttctgaaacgttatttctgtaatgttgttaaaatgtgcgtggttccctgatttcaatcaaaacctgtatggacagaaggtgaatactttgttactttagcgtcaagaacatgaaattggtcagaccaattgactccggttaaatggcactccgggaaaacggcttaggacagggaacaatggcctacagtaaaatccgccaacctaaattatccgatgtgatagagcagcaactggagtttttgatccttgaagggacattgcgccccggtgaaaaacttcctccggaacgtgagctggctaaacagttcgacgtttcccgtccttcgctgcgcgaggcgatccaacgccttgaagccaagggcctgctactgcgtcgccagggcggtggtacctttgtccagagtaacctgtggcagagcttcagcgatccgctggtagagcttttgtccgatcaccccgaatcccagtttgacctccttgagacgcgccacgcgcttgaaggcattgccgcctattacgcggccttgcgtggcaccgacgacgatcgcgcgcgcatccgcgagctgcatcaggcgatcgagcgcgcgcaggaatccggggatctcgatgccgaagccgatgccgtcgtcctgtatcagattgccgtcaccgaagcggcgcacaatgtggttttgctgcatttgctacgctgcatggaaccaatgatggcgcagaacgttcgtcagaattttgaattgctgtatgcccgccgggaaatgctcccgctggtaagcaaccatcgctccagaatttttgaggcgattatcgccagagagccggagcaggcgcgtgaagcgtctcaccggcatctggcgtttattgaggaaatattgctggaccgcagccgtgagcagagccgtcgtgaacgctccatgcgccgcctacagcaaagaaaggattaagcgccataatttagagcgcggcaactaaacgcagaacctgtcttattgtgttttctgccgaaaatacaatgggacaggttccagattaatcaacgaaaattagatagataaggaaaaacccatgtcagatcgtttaatcaatgacgtggatccgatcgaaactcgcgactggcaacaggcgatcgaatcggtcatccgtgaagaaggtgttgagcgcgctcagtatctgattgaccagttactgtctcaggcccgcaaaggcggcgttaacgtggcagctggttcaaacgctcgcaactatgtaaatactattgccgttgaagatgagccggaatacccgggtaatctggagctggaacgtcgcattcgttctgctatccgctggaacgccatcatgaccgtgctgcgtgcgtctaaaaaagacctcgagctgggcggccacatggcgtctttccagtcttctgcgactgtgtatgaagtttgcttcaaccacttcttccgcgcacgcagcgagaaagacggtggcgatctggtgtacttccagggccacatctctccgggcgtttacgctcgcgcattcctggaaggtcgtctgactgaagagcagatgaacaacttccgtcaggaagttcacggcaatggcctgtcttcctacccgcacccgaaactgatgccggaattctggcagttcccgaccgtctctatgggtctgggtccgattggtgcgatctaccaggctaaattcctgaaatatctggaacaccgtggtctgaaagatacttcccagcaaaccgtttacgccttccttggcgacggcgagatggatgagccggaatccaaaggcgcgatcaccatcgcgacccgtgaaaaactggataacctggtcttcgttatcaactgtaacctgcaacgtctggacggcccggtaaccggtaacggcaaaatcatcaacgaactggaaggcatcttcgaaggcgctggctggaacgtaatcaaggtgatgtggggcggtcgttgggatgagctgctgcgtaaagacaccagcggtaaactgatccagctgatgaacgaaaccgttgacggcgactatcagaccttcaaatccaaaaacggcgcgtacgttcgtgagcacttcttcggtaaatacccggaaactgccgcgctggttgccgactggtctgacgatgagatctgggcactgaaccgtggtggccacgatccgaagaaagtctacgctgcattcaagaaagcgcaggaaaccaaaggcaaagcgactgttatcctggcccataccatcaaaggttacggcatgggcgacaccgctgaaggtaaaaacatcgcccaccaggtgaagaaaatgaacatggacggtgtacgttacatccgtgatcgtttcaatgtgccggtgaccgatgagcaggttgagaagctgtcctacattaccttcccggaaggttctgaagagcacacctacctgcacgcccagcgtcagaagctgaacggctacctgccgtctcgtcagccgaaattctctgagaagcttgagctgccgaccctggctgacttcaaccagctgctggaagagcagaacaaagagatctccaccactatcgccttcgtgcgtgccctgaacgtgatgctgaagaacaagtcgatcaaagatcgcctcgtaccgatcatcgccgacgaagcgcgtactttcggtatggaaggtctgttccgtcagattggtatttacagcccgaacggccagcagtataccccgcaggaccgtgagcaggttgcttactataaagaggacgagaaaggtcagatcctgcaggaaggtatcaacgagctgggcgcaggttcttcctggctggccgctgcgacctcttacagcaccaacgatctgccgatgatcccgttctacatctactactccatgttcggtttccagcgtatcggcgacctgtgctgggcagcaggcgatcagcaagctcgtggcttcctgattggcgggacttctggtcgtactacgcttaacggcgaaggtctgcagcacgaagatggtcacagccacattcagtcgctgaccatcccgaactgtatctcttacgatccggcttacgcctacgaagttgctgtcatcatgcatgacggtctgcatcgtatgtacggtgaagcgcaagagaacgtgtactactacatcaccacgctgaacgaaaactatcacatgccagcgatgccggaaggcgccgaggaagggatccgtaaaggtatctacaaactcgaaactgtcgaaggcgcgaaaggtaaagttcagctgctgggctccggttctatcctgcgtcacgtacgtgaagcagcgcagatcctggcgaaagactacggtatcggttctgacgtgttcagcgtgacctccttcaccgaactggcgcgcgatggccaggattgtgagcgctggaacatgctgcacccgaccgacgagccgcgcgtaccgtacgttgcacaggttctgagcgacgcaccggcagtggcatcaactgactatatgaaactgttcgctgagcagatccgtaacttcatcccggcaagcgattaccgcgtactgggtactgatggcttcggtcgctctgacagccgtgaaaacctgcgtcaccacttcgaagttgatgcttcttatgtggttgtggcagcactgggcgaactggctaaacgtggcgacatcgacaagaaagtagttgcagaagcaattaccaaattcaacatcgatgcagataaagttaacccgcgtctggcgtaagaggtaaaagaagaatggctatcgaaatcaatgtaccggacatcggggctgatgaagttgaaatcaccgagatcctggtcaaagtgggcgacaaagttgaagctgaacagtcgctgatcaccgtagaaggcgacaaagcttctatggaagtcccgtcacctcaggctggcgttgttaaagagatcaaagtctctgttggcgacaaaaccgagactggcaaactgatcatgattttcgattccgctgacggtgctgctgatgcagcacctgcgaaagcagaagagaagaaagaagcagcaccggcagcagcctctgcaccggctgcggcggctgccaaagacgtcaacgtaccggatatcggcggcgacgaagttgaagtcaccgagatcatggttaaagtcggcgacaaagtggctgctgagcagtcgctgatcaccgtggaaggcgacaaagcctccatggaagtcccggctccgttcgcgggcaccgtgaaagagatcaaaatcagcaccggtgacaaagtgtccaccggctccctgatcatggtcttcgaagtggaaggcgccgctccggctgccagcgacgcgaaaccgcaggttaaagaagaagcggcttctgctccggcagcagcggcgggcgcgaaagacgtcaacgtaccggacatcggcggtgacgaagttgaagtgaccgaagtgatggtgaaagtgggcgacaaagttgccgctgagcagtcactgatcaccgtggaaggcgacaaagcctccatggaagttccggcaccgttcgcgggcaccgtgaaagagatcaaaatcagcaccggcgacaaagtgtctaccggctccctgatcatggtcttcgaagtggaaggcgcagccccggctgcggctccggctgcggccaaacaggaagcagcaccagcaccggcggcgaaagcaccggccgccgctgcaccggcgaaagcggaaggcaaatctgagtttgctgaaaacgacgcttacgtccacgcgaccccgctgatccgccgcctggcgcgcgaattcggtgtgaacctggcgaaagtgaaaggtacaggtcgtaaaggccgtatcctgcgcgaagacgttcaggcttacgtgaaagacgcggttaaacgcgctgaagcggcacctgctgctgctaccggcggcggtctgccgggcatgctgccatggccgaaagtggacttcagcaagtttggtgaagtggaagaagttgaactgggccgtatccagaaaatctctggtgctaacctgagccgtaactgggtgatgatcccgcacgttacgcacttcgacaaaaccgacatcaccgatctggaagccttccgtaagcagcagaacgccgaagctgagaagcgcaaactggacgtgaaattcaccccggttgtcttcatcatgaaagccgttgccgcagcgctcgagcagatgcctcgcttcaacagctccctgtctgaagacgcgcagcgtctgacgctgaagaaatacatcaacatcggtgtggctgttgataccccgaatggcctggtggttccggtgttcaaagacgtgaacaagaagagcatcaccgagctgtcccgtgaactgaccgtgatctccaaaaaagcacgtgacggtaagctgacggctggcgaaatgcagggcggttgcttcaccatctccagcatcggtggcctgggtactacgcacttcgcgccgatcgttaacgcgccggaagtggctatcctcggtgtgtccaaatccgcgatggagccggtctggaatggtaaagagttcgtgccgcgtctgatgatgccgatctctctgtccttcgaccaccgcgtgatcgacggtgctgatggtgcgcgtttcatcactatcatcaataacatgctgtctgatattcgccgtctggtgatgtaaataagaaagccggcctgacggtcggcttttttctggtaatctcattatgttactggggttattgggacaaaggacaactcgtttaccgtttgttgtttcaaaattgttaacaattttgtactatgcgggcggatagaacgtcccggcgaagaagggcgatacgtcccctggactgccggaaatcaataagaggtcatgatgagtactgaaatcaaaactcaggtcgtggtacttggggcaggcccggcaggttactctgctgccttccgttgcgctgatttaggtctggaaaccgtcattgttgaacgttacaacaccctcggcggtgtttgtctgaacgtcggctgtatcccttctaaagcgctgctgcatgttgctaaagttatcgaagaagccaaagcgctggctgagcacggtatcgtcttcggcgaaccgaaaaccgatatcgacaagattcgtacctggaaagaaaaagtcatcacccaactgactggcggtctggccggtatggcgaaaggccgtaaagtaaaagtggtgaacggtctgggtaaattcaccggggctaacaccctggaagtggaaggcgaaaacggcaaaaccgtaatcaacttcgacaacgcgatcatcgcggcgggttcccgtccgatcgaactaccgttcattccgcatgaagatccgcgcgtatgggattccaccgacgctctggagctgaaagaagtacctaagcgcctgctggttatgggtggcggtatcattggtctggaaatgggcaccgtgtaccatgcgctgggttcagagatcgacgtggttgaaatgttcgaccaggtgatcccggcggctgacaaagatatcgttaaagtcttcaccaagcgtatcagcaagaaattcaacctgatgctggaaaccaaagtgactgccgttgaagctaaagaagacggtatttacgtttccatggaaggcaaaaaagcccctgctgaagcgcagcgttatgacgccgtgctggtggctatcggccgtgtgccgaacggtaaaaacctcgacgcaggcaaagctggcgtggaagtggacgaccgtggctttatccgtgtcgacaaacagctgcgtaccaacgtaccgcacatcttcgctatcggcgatatcgtcggtcagccgatgctggcgcacaaaggcgttcacgaaggtcacgttgccgctgaagttatcgccggcatgaagcactacttcgatccgaaagtgatcccgtccatcgcgtacaccgagccggaagttgcctgggttggtctgaccgagaaagaagcgaaagagaaaggcatcagctacgaaaccgccaccttcccgtgggctgcttctggccgtgctatcgcgtccgactgcgcagacggtatgaccaaactgattttcgacaaagagactcaccgtgtgatcggtggcgctattgtcggtactaacggcggcgagctgttgggcgaaatcggtctggctatcgaaatgggctgtgacgcggaagatctggcgctgactatccatgcgcacccgactctgcatgagtccgtgggcctggctgctgaagtgttcgaaggtagcatcaccgacctgccgaacccgaaagcgaaaaagaaataagcgtctgagtttgtgttgccgggtggcggcttcgccttacccggcctgcaaatttaaaagatgtaggcccggcaagcttgcgccgccgggcaaacaggaccggacattaaagcggcttaatagccgctttttttatgcccgcgttttaccttcagggctgcaccggttgccactgctcgtccggcgtaaactgcgttatccccgcaatctgctgcgccgtctgcgcgccgaaatcccgctgatatacccgatcctgaccgtcaaccacaaaggtggcgacgccggttttgccgtagtccagcggccacgccagcagcgcggcaggcgcatcattaccttgccccttacccgtcagcagccggaaacgatagccgtgataaccctcgccgggcgcggtcgggctgaacgccgggccaagcgggctgtgcgcttcccccggtgacaccggccagtagaggccatcttttttaccctcgctgctgataagcttctgcgcgtaatggtggttaagggcgaagtaatcccgctgcgcgtccaaataagcctggagcgcgttaatagctgacagctcattgcgcccgagggtacgggtgaggatttcgtcggcggcgcgtgcggtatcaaactgccagcccgcggcggttttcaccatcgggatggggagctgccactgactgcgcccgacactcaggtgcgccacgccgttctgctcatcaatctgatggcttatctgccagtcgcgcagaaaacgcgccacggcttgcgcatctgccccgtccggcggcaggatctgctgccagtcatcgccgagcagttgcgtcagcacgctgtcattttgatcctggatggcgctgactagcgtactggcggcctgctccggcgtgctgaacgcctgctgcgcctgacccatcaccggtaacagcagcagcaatccggcgataattttctgtagtttcatgatccctgcctgattaacgacggttaagttcacggcgttcggccgcatgttcacgtaacgagctgcgctgttcgcggttcagacgctggcggctctgttcgccgcgctgacgctgcgcctgccaggacggtgaacggctgtcattgccgctcaacgccgtggcgcgggaagcgctctggcgctgctgcagcttttcccgccgctgttgctgttgcggcgtcgggttatcgtggcgggctttgatggcatcgcggcgctgttgctgctgcgcggtgggattgtcccggcgggcctgtatcgcctcgcgtttctgctgcgtcgtggactgattgaactgagtttttgccgcctcgcgacgggcggtagtggtgggagtatcgtaaccgcgataattattgcgctgcgcgatctggtttaactgctttgctgccgtctgacgctgcgcatcgcgggagggcaggttattacggaagacgggattgtgctgccacaccacagtgtcatttctggtgaccagcctgccgccggaaatgcggttgaagttattgacgttgatattgatgttatcgccgttatggtcgtagccgcgatggtaatgatcgtcatcccagtcaatatcgctgaacagcgcataagtggtggcgacgccgagactgaaacctaagccccgcaccaggctgtcggtgaactgctggccgggaggcggcggcagatacaccggcggataggcgggcgtcggccagctgccgtacactacggtcgggttatagctcgggacatacaccacctccggatcggcgggttcgattttgatcaccgtcggggctggcgtactcaccacggtagtgctgccggacgcggattgcggcgcggtactgcttttcgccggtacggtgctgactttctgctgcggcgtggaggtgagcgcgcccgtctgctgcgccagcgcgcgcagcttctgcactgaatccattacctctttcggctgcgccagaaaggcatcgccgaggttttgcacccactgtgggttttcccccatcaatgccatcagcgacggaaaggccaccagcgatctgacgctcggatcccagggctggttaatcaccgcctggatcgccgcgtcgccctggagcgtgggattatcctgcgaccactgcgccgcctgcacgacgtttgcggggtaggtggcggccatcagcacctgcgagagcagcgcgtccgggtagagcgcgattggtgccacccactgatcgatttgcgccgtggtaaaggttgaggtggcgaccggcggggcgggcggcggggcgggcgtaaccggctgggcgacaacggcaggcggcggtgtttccggcgtcctgcttttgacatagagcacgcccgaggcggctaaaaccccggcgctgcacagcagcatcaggatctgaggtttgaatggcaacttcatgaggttctcccggtatccggtgggatacacgcgaataaaacacaggccagatggcggtaaatgcccgcgagtataaagcgctgattgtttattttttgattaaaacaggcatcgcaccgtgccccgtccataaccggacaacaagagtgttagtaaacattgcaaagcgtagggataagcccttttgcagagtcagccgtgggggataaaaaggtattttcgtctgccggagaagccctgtgaaagagaggtgtatcgcccgtaacgattcagctaatttttaatgttgcttttttgtaaacagattaacaccccctttaaatcctgctatgctgcccgtcgcggtaccgggcttttaccctacaaactgctgtctcacaggagcgtgaagaaactgccggccgcactatgacaatgagagcgaggagaaccgtcgtgctagaagaataccgtaagcacgtagctgaacgtgccgctgaagggattgcaccaaaacccttagatgccacgcaaatggctgcgctggtcgagctgctgaagtccccgccagtgggcgaagaagaattcctgttagatctgttagccaaccgtgtcccgccgggcgttgatgaagccgcctacgttaaagccggtttccttgcagccgtcgccaaaggcgaaaccgcctctccgctggtcactccggaaaaagccattgaactgctgggcaccatgcagggtggttacaacatccatccgctgattgacgcgctggacgatgctaagctggcgccgggtgccgccaaagcgctgtcccacacgctgctgatgttcgacaacttctacgacgtggaagagaaagccaaagcgggcaacgcttacgcacagcaggtgatgcactcctgggccgaggcagaatggttcctgagccgtccaccgctggctgaaaaaattaccgtcaccgtctttaaagtgaccggcgaaaccaacaccgacgatctctctccggcgccggatgcctggtcgcgcccggatattccgctgcacgcgctggcgatgctgaaaaacgcccgtgaaggcattgtgccggatcagccgggtagcgttggcccgatcaaacagatcgaagagctgaacaaaaaaggcttcccgctggcctacgtgggcgacgtggtcggtaccggttcatcccgtaaatccgccaccaactccgtactctggtttatgggcgacgacattccgaacgtgccgaacaagcgcggcggcggtctggtgctgggcggcaaaatcgcgccaatcttcttcaacaccatggaagatgccggcgcgctgccgattgaagtggacgtgaacgcgctgaacatgggcgacgtgattgacgtctacccgttcaaaggcgaagtgcgtaaccacgaaactggcgaactgctggcgaactttgaactgaaaaccgacgtgctgatcgacgaagtgcgcgccggtggccgcatcccgctgatcatcggccgtggcctgaccaccaaagcgcgtgaagcgctgggtctgccgcacagtgaagtcttccgtattgctaagccggttgcggcgagcgataaaggtttctcactggcgcagaaaatggtgggccgcgcctgtggcgtgaagggcgttcgccctggcgaatactgcgaaccgaaaatgacctcggtgggctcgcaggacaccaccgggccgatgacccgtgatgaactgaaagacctggcctgtctgggcttctctgccgatctggtgatgcagtccttctgccacaccgcggcctatccgaagccagtggacgtcaccacacaccacacgctgccggactttattatgaaccgcggcggcgtctcgctgcgtccgggcgacggcatcatccactcatggctgaaccgtatgctgctgccggataccgtgggtaccggcggtgactcccatacccgtttcccgattggcatctccttcccggcaggctctggtctggtggccttcgccgccgcgaccggcgtgatgccgctggatatgccggaatctgtgctggtgcgctttaaaggccagatgcagccgggtatcaccctgcgcgatctggtgcacgccatcccgctgtatgccattcgccagggtctgctgaccgttgagaagaaagggaagaaaaacatcttctctggtcgcatcctggaaatcgaagggctgccggagctgaaagtagagcaggcgtttgaactggcggatgcgtcagcggaacgttctgcggcgggctgtactatcaagcttgataaagcgccgattgaagaatacctgacctccaacatcgtcctgctgaagtggatgattgcggaaggctacggcgaccgccgtacgctggagcgtcgtattcagggcatggaaaaatggctggcggatccgcagctgatggaagccgatgctgacgccgaatacgcggcagtgatcgacatcgatctggcagatatcaaagagccgatcctgtgtgcaccgaacgatccggatgatgcgcgtctgctgtctgacgtggcgggtgagaagattgacgaagtgtttatcggttcgtgcatgaccaacatcggtcacttccgcgcggccggtaagctgctggacaaccataaaggccagctgccgacccgtctgtgggtcgcgccgccaacccgtatggatgccgcgcagctcaccgaagagggctactacagcgtgtttggtaagagtggcgcgcgcgttgagatcccgggctgttcactgtgcatgggtaaccaggcgcgtgtggcagacggctcaacggtagtgtccacttcgacgcgtaacttcccgaaccgtctgggcaccggcgcgaacgtgttcctggcgtccgcagagctggcggcggtctcttccctgctcggcaaactgccgacgccggaggagtaccagacctatatggcgcaggtcgataagaccgcggtagacacctatcgctatctgaacttcgacaaactcggtcagtacaccgaaaaagctgacgcggtgatcttccagactgccgtataagtgagcattctccactggtgagaaaacaagggtgagggcggtgatccgcgctcaccctttttatttctatatcctccgcccgtcccgctgtttttctttcccgctgctgcgataattaccccattgctggatcagaggaatgcatcatggattacgaatttttgcgtgatatcaccggcgtggtgaaggtacgcatgtcgatgggccacgaggtggtcggtcactggtttaatgaagaagtgaaagagaacctcgccctgcttgatgaagtggaagcggcggcgcggacagtgaaaggcagcgagcgtcagtggcagcgcgtcggacacgaatacaccctgtggatggacggcgaagagatcatcgtgcgcgccaaccagctggagttttccggcgacgagatggaggaggggatgaattactacgacgaggagagcctgtcgctgtgcggcgttgaggatttcctgcaggtggtaaaagcgtaccgcgaattcctgcagcagaaataatcatcacggagcgtccctgctccgtaaaccggtcttacacggcgggaatattgcggccgtaatagatttcgcgcatctctttccacagcgcttcggtgatcactttacgctcgtcggcggtgagatcttccgggcgggtgtggaacatatagtgtttcaggtcgaattctttcagcaacatcttggtgtggaagatattttcctgataaacgtttacatccaccatgtcatacagcgctttcatgtcatcggacaggaagttctgaatcgaattgatttcatgatcgataaagtgttttttacccgacacgtcgcgggtaaagccgcgcacgcgatagtcaacggtcacaatatcggactcaagctggtggattaaataattcagggctttcagcggtgaaatcaccccacaggtcgagacttcaatatccgcgcggaaggtgcacagtccgccctccggatggctttccgggtaggtgtgaacgcagatatggctcttgtcgaggtgagctaccacggtttccggcagcgggccaggatgttcagtgttgtcgatcagatgcggttcaacgggctcttcgctgacgaggatcgtcacgctggcgccctgcggctcataatcctgacgggcgatattcaggatattcgcgccaataatcgaacaggtttccgtcaggatctccgtcagtcgattggcgttatagagttcatcgatataggcgatataaccatcgcgctcttcagccgtattggcataacagatatcgtaaatacaaaaactcaggcttttggtcaggttattaaagccatgtagtttaagctttttcaatttttatcacccccttaggatcactgcgcaaacagtgcatcgtgcaaatattgtggtaacgcgaacgccgccgtgtgtactgccggattgtaataacgacacgtcaggtttgcgctgtggaaacgcgcctgaataatgccggtagaaagatgacgcagcgcgccgttgtccgtcgcccaggcgaaggtcatcacaccaccgtaataggtgggaatggcggcctgataaaaactcacatcgtcaaagtaatggctgagtttacggtgactgtcgatggcttcatcctgctgcaaaaagctcacgccgttttgcgcgacgaaaataccgccaggattcaggcaacgcttgcagccttcgtaaaatgccgaggtaaacagactttcgccaggcccgatgggatcggtgcagtcagagatgatcacatcaaaggtttgcgcggtctggttaacaaaattgacgccgtcgtcaatcaccagcgtaaagcgcggatcgtcataagccccggcattatgattcggcaaatactggcggcagaatgacacgacgcccgcgtcgatctccaccatggtgatggtttcgatactcttatgacggctcacttcgcgcagcatcgcgccgtcgccgccgccgatgatcagcacatgcttcgcatgaccgtgcgccagcagcggtacgtgggtcatcatttcatgataaatgaactcatcccgctcggtggtttgcaccacgccatccagcgccattacgcgcccgaatgcggcgttttcaaagataatcagatcctgatgatcggttttttcgtggtacagcaccttgtccacggcgaagtactgcccgaactggtcatgcagcgtttcgtgccacagtttgctatcagtcattgctcgctccttcgttaacacccatataaaacgggcgtaacatgatagctaactagtgacggggatgcacggctataaatccctgccccgcagaaggggcagaggaagggttatttcacgtaggcaagcaggctcagggaatcacgcgccagcgctttgcattttttatccgtggcgatgccaatgccgctgaggtcgcggtagctgtcttcccccagcgctttcatgtcaaagctctcgtagttgctcagatcccactgattctgctgggcgaaaaacaccagcgcgcgacggatctgaccgttcggtaaattctggtagccacagtcgtttttcaggaatacaaacaccgccgttaaatcggccatgtcttcggcttctgactcactgagtgcataactatttgctgatacagccagcaggctggcgaacgtaattgttctgaaaaacgtcttcattatttctaccggaacatcgaggaaatttaacgttagcatacttgggggcagggcgacgatctttattattagaggttcgcttgaccttaccgcaagggcagggtttatgctcaaaagctcgccaggctttaaaaagggaataaagatgcaacgtcgtgattttataaaatactccgctgcgctgggcgcgatgagcgcgctaccgggatggacgaaagcggcctttgccgccgcgccgcaagctctgccaatcccggcgctgctgacgccggacgcgcagagccgcattcagttacgggcgcaggctggcaccaccgccttcgccgggaaaaacgccgccacctggggctataacggtaatctgctaggtccggcgatcaaactgcgccagggtaaggcggtgaccattgagatcaacaaccggctggcggaagaaacgacggttcactggcatggcctggaagtgccgggcgaggtggatggcggaccgcagggcattatcaagcccggcggccagcgtaccgtcagctttacccccagccagcgcgcggccacctgctggttccatcctcatcagcacgcaaaaaccggtcatcaggtggcgatggggctggccgggctggtgctgatcgaagatgacgagagccgcatgctgcgtctgccgcaacagtggggtattgatgacgttccggtgatcgtacaggacaagcgttttaacgccgacgggcagatcgactatcagctggacatcatgagcgcggcggtcggctggtttggcgatacgctgctcgccaatggtgcgatctatccccggcatgccgccccgcgcggcttgctgcgcctgcgtctgctgaacggctgcaacgcccgctcgcttaacttcgccaccagcgacaagcgcccgctctatgtgattgccagcgatggcggcctgctggcggagccggtgaaagttgccgagctgccgatgctgccgggggagcgttttgaagtgctggtggagacccgcgacgggaaagacttcgacctgatcaccctgccggtcagccagatgggcatggcggttgcgcctttcgacaagccgcagccggtgctgcatattcagccgctgaccgttgtggcgtccggcgagctgcctgataccctcgcgaccatgccatcgctgccgccgctggatggcctgacgcagcgcacgctccagctgtcgatggatccaatgctcgacatgatgggaatgcaggcgctacagaaaaaatatggcgatcaggcgatgaccggcatggcggggcacatgagtcatggcgggatggatcacggcagtatggatcacggcggcatgaaccatggcgggcagggcgttgatttccgccatggcaatatgattaacggtaaagccttcgacatgaacaccccggcctttgccgcgaccaaagggcagtacgagcgctgggtgatttccggggagggggacatgatgctgcatccgttccatatccacggcacgcagttccgcattctgtcagagaacggcaagccgcccgcggcgcatcgcgcaggctggaaagatatcgtcaacgtatttggcgcgcgcagcgaagtgctggtgaagtttgactatgacgctccgaaagcgcaggcctatatggcgcactgtcatctgctcgagcatgaagatacggggatgatgcttgggtttacggtataaaaaaaccgggtggcggcgtcgcctcacccggtatgcttaacagggctgcccggaacgcttagcgaaccgggcattttttactattacttcgcctcatccggcagcgcataggccacaatatagtcgcccattttggtgccaaacgaaccgtgaccaccggcggaaatgactacatactgtttgccattcacttcataggtcatcggcgtcgcctgaccacccgccggcagacggccctgccacagtttctcaccgttgctcatgttgtaagcgcgcaggtagttatcggcggtagcggcgataaacagcacgttaccggcggtggaaatcggaccgcccagcatcggcatacccatattgaacggcaccgggatcggcatcgggaacggcaggctgtcctgcggcgtaccaatacgttttttccacactacgtcgttggttttcagatccagcgcggagatataaccccaggcaggctgtttacacggcagaccaaacggcgacaggaacgggttcagcgtcacgccatacggcacgccgtactgcggctggatcccggcttcggtaccgctgcctttcgcgtctttcggctgttccatcggattgcccggaccgcgcggcatcagtttggaaacaaacggcagcgccatcgggttagcaatcgccacctgacggttcggatcgacggaaataccgccccactcgaacataccgaggttacccgggaacaccagcgtgccctgctcggacggcggggtgaagatgccttcatagcgcagctgatggaacataacgcgacagaccagctggtcaaacatggtcgcgccccacatatccgcaccggtcagatctttcttcggacggaagctcagctcagagaacggctgggttttggtaacgtaatcgcctttcgccgcgccctgcggaaccggtttttccggtgccgggacaaccggctcgccattacgacgatccagcacgaagatgttaccggttttcgccggcgcgtagatcaccggtacggttttaccgttaacggtaatatccgccagcgtcggctgggccggtaaatccatatcccacagatcgtggtgaacggtctgatagctccaggccagtttaccggtggtggcgttcagcgccagcacggaactggcataacgctcctgctccggcgtacggttgccgccccagatgtccggggtgctcacgcccatcggcagatagaccagatccagcttggcgtcataggccgccggggcccaggagttcggcgagttaaaggtgaagctatgttcgtcagacgggatagcgttcggatctttcgcgcccggatcgaaggcccacagcagtttaccggtgttcacatcaaaaccacggatcacgccggacgtttcgcgggtggagaagttatcggtgacggaaccggcaatcacgatagttttatcggtaatgatcggcggcgaagtcggttcgtacagacccggcgtggtatccggcatgttggtttgcaggttcagaatacctttgttggcaaaggtttcgcacagcttaccgttatcggcgttgatggcgaacagacggccatcgttcaccggtaacatgatgcggcgcggacagtctgcgatcacttccgggctggcattgtcggcgcgcgcttcgtggtaagaaacaccacggcaggtaacgtgctggaacgaggtattagtattcagctgcggatcaaagtgccacttctctttaccggtcgctgcgtccagcgcaaacagacgctggtgcgcggtgcagagataaagcatgttgccgactttaatcggcgtcacttcgttggtcaattcacccggatcgttaggctgtttcagatcgccggtgcggaacacccaggcttctttcagatccttaacgttatcgacgttgatctgcttcagcggggagtaacgctggccttcctgattacggccataggctggccagtcggcgtcggccacctgggaaatcggctctgccggcgtggcgtcggcgctcagggtgccgttcacttcctgcggatcgttaaagcctgcccaggtcagcatcgcgccgctaaccagcagcgccacaaccagcgccgctactgcgccgcgggaaggcaccagcagacgacgccagacgaacggcaggatcagccagataccgaagaagaccagaatatcgctgcgtggggttaaggcccagaagtcaaagccgacttcccatacgccccaaatcatcgtacccagtaacagcgcggcgtagacccacagcgctgagcgcttgctgcgccacagcagccaggtgacggcgagcatcaccagcccggcgacagggtagtaccaggagccgccaatcgcgaccagccaggcgcccccgataagcaggtatagtccgcagaaagcggcgaacagcgcggtgatcgtcacgagtgtgcgtgacggatgcggtttattttctgccataaaagacactcatctcattttgttaatattttggaagcaattaattataggatttaacaagtgtgacagtcatcacaattctggcttttattatctcgtcccccggccgggggcatttactggtatactgacgcgcttatgaattgatgccggacgatacgctatccgcattgagtgattgttttttaaatcatacggttagagaaatgaaacatactgttgaagtgatgatcccggaagccgagatcaaagcgcgcattaccgaactgggtcgtcaaatcactgagcactataaggacagcggcagcgagatggtgctggtgggcctgttacgcggctcgtttatgtttatggcggatctgtgtcgtgaagtgcaggtgcctcatgaagtcgattttatgaccgcctccagctacggcagcggcatgtccaccacgcgcgacgtaaaaattctcaaagacctggatgaagatatccgcggtaaagacgtgctgatcgtcgaagacattatcgactccggcaacacgctgtcgaaagtgcgcgagatcctgagcctgcgcgagccaaaatccctggcgatttgtaccctgctggataaaccgtcccgccgtgaagtgacggtgccggtggaatttgtcggtttctcgatcccggatgagttcgtggtgggttacggcattgattacgcccagcgctatcgtcatctgccgtacatcggcaaagtggtgatgcaggacgagtaagcgtaaaaaagcccggtggcgctacgcttaccgggcctacatgtcagttcgtcgttacgtaggccgggtaaggcgaagccgccacccggcataaaaacataacgaatcttatttgtgattaatgtgcttctggctaatgttggacagcccctggcggtaacgcgattccagcgtgtcgcggttggtggcggttacttccagatcgcgcagcagaccgtcgtgaataccgtacgcccagccgtgaatggtcacgttctggccgcgcttccacgctgactgcatgatggttgagtggcccaggttatacacctgctccatcacgttcagctcacacagggtatccagacgacgctcttccggcatttcgttaagcagtgcgctatgtttaaaccagatgtcacggatgtgcagcagccagttgttgatcaggcccagttccgggttttccaccgccgcctgcacaccgccgcagccgtagtgaccgcagatgatgatgtgctcaacttccagcacatccaccgcgtactggacgaccgacaggcagttcagatcggtgtggatcaccaggttggcaacgtttcggtgaacaaataactcaccgggttcaagaccggtcaggcgctcagccggaacgcggctgtctgaacagccaatccataaaaagcgcggtttctgtgcctgtgctaatgtctcaaaaaatcccggatcctcttcgaccagcatttttgaccatagtgcattgttactaatgagtgtatctatgtctttcattgaggttaacgacctgtaaccaagtaatagcgttgagctaatataggtcaactccatttttttttaaaccacacatagagtgtaagaaaaaaggtaagaaagcagtcatgaccattgcactggagcttgagcagcttaaaaaaacctacccgggcggcgttcaggcgctgcggggtattgatttacaagtagaagcaggggatttctatgcgctactcgggccaaacggcgccggtaagtcaaccaccatcggcattatcagttcgctggtaaataaatcttccggacgggtcagcgtctttggttacgaccttgaaaaagatgtcgtcaacgccaaacgccagctcggtctggtgccgcaggagttcaactttaacccgtttgaaaccgtgcagcagattgtggtgaaccaggccggttactatggcgttgagcgtgccgaagcggtagcgcgcagcgaaaaatacttaaagcagctggatttgtgggaaaaacgcggcgaacgtgcgcgtatgctctccggcggcatgaagcgtcgtctgatgattgcccgcgccctgatgcatgaacctaaactgctaatccttgacgagccgaccgcgggcgttgacatcgaactgcgtcgctccatgtggggctttctgaaggatctgaatgacaaaggcaccaccatcattctgaccacccactatctggaagaagcggagatgctgtgccgtaatatcggcattattcagcacgggcaactggtggaaaacacctccatgaaatccctgctggcgaagctcaaatccgaaacctttattctcgatctggcgacgaaaagcccgttgccgaagctggaaggctatcagtatcgtctggtggacacctcgacgctggaggtcgaagtgctgcgcgagcagggcatcaatagcgtgttcagccagctgagcgcgcagggtattcaggtattaagtatgcgtaacaaagcgaaccgtcttgaagagctgtttgtcacgctggtaaacgaaaaaacaggagaccaggcatgatgcagctttattgggtcgcgctgaaaagcatctggcataaagaaattcagcgttttatgcgtatctggatccagacgctggtgccgccggtcatcaccatgacgctctatttcatcatcttcggtaacctgatcggctcgcgcattggcgaaatgcacggctttacctacatgcagtttatcgtgccgggtctaatcatgatggcggtgatcaccaatgcttacgccaacgtcgcctcgtcgttcttcagcgccaagttccagcgcaatattgaagaactgctggtcgcgccggtgccgacgcatgtgattattgtcggctatgtgggcggcggcgtggcgcgtgggctgtgcgtcggcgtgctggtgacggcgatttcgctgttcttcgtgcccttccaggtgcactcctggctgttcgtcggcctgacgctgctgctgacggcggtgctgttctcgctcgccggactgcttaacgccgtattcgccaagacctttgatgacatcagcctgatcccgacctttgtgctgacgccgctgacctaccttggcggggtgttctactccctgacgctgctgccgccgttctggcaggcgctgtcgcacttaaacccgatcgtctacatgatcagcggtttccgcttcggtttcctcggcatcagtgatgtgccgctcatcactaccattgccgtgctggtggtgtttatcgtggcgttttatgccttgtgctggtatctgatacagcgcgggcgcggtctgcgcagctaaccggttccccctctcttaacggagagggggcgctgaaatccattggtattacgaatgcttttgttacaatgcgcgcagaatttcctcaccacagttaagccatgctgatccgtttcgcttttactctgctgattctgctctccggcagcgcttccgccagcctgttgggccagccgaccgccaccgaacgttatatgcaaaccaccgaagatgccgccgtctgggcgcaggtgggcaatgaagtcattaccgtcgggcatctgaatgccggacagatcatcgccgtagcgcccacagccgccgactattacgaattccgcttcgggtttggcactggctttattgataaacagcatctggaagcggtgcagggaaaacagcgggtcgaggacagccttggcgatctgaacaagccgctcagcaatcagaacctgatcacctggaaaccgacgccggtctataacggccccaacaccggcagcgcgccctttggcatgctggtggaaaacctgcgctatccggtaatcggcaagctgaaagacggtctgaaccagacctggtatcagatccgcattggcaaccggctggcgtacgtcagcgcgctggacgcccagcaggatgaagggctgccgatcctgacctatcaccacattctgcgtgacgaggaaaatacccgtttccggcatacctccaccactacgtccgttcgcgccttcagtaaccagatgacgtggttgcgcgatcagggatacaccacgctgaccatgtctcagctggaaggctacgtgcacaaccggatgaacctgccggcgcgggcggtggtgatcacctttgacgacggcctcaagtcggtgagccgctatgcgtacccgatccttaagcagtacggttttaaagccacctcctttaccatcacctcgcgcatcaagcgtaagccagaaaagtgggatccgaaatcgctacagtttatgagcatttcagaaatgcagcagatccgcgatgtgtttgatttccagtcgcacacgcattttctgcaccgggtggataatagccgccatcccattttactgagccgcagctaccacgtggtattgttcgattttgagcgctcccgccgcgcgctggcgcagtttaatccccatgccctgtatctgtcctacccgtttggcggctatgacagcaaggcggtgaaagcggcccaggacgcgggctttcatctggcggtgacgacggtgaagggaaaggtaaaaccgggggataatccgttcttattaaaacgactctatattctaagaacggatcctctggagaccatggcgcggttaattgttaaccggccacagggttaactcaggcaacctgcaccggcacggctttcgcggtgcgtttcatctcgttgtcgccgtcaaaataggccactttcggctgccagctgcgcgcctgctcatcaggcatggtgacgtagctggcgatgatcagaatgtcgcccacatccgcgcagtgcgccgcagcgccattcacggaaatgatgcgtgaaccgcgctcaccggcaatcgcataggtggaaaagcgcttaccgttagtcacgttgtaaatatcaatggcttcgtattccagaataccagccgcctcaaggaaatcctggtcgatggcgcaggagccttcgtaatgcaggtcagcctgcgtcactttgacgcggtggagcttgccttgcagcatagtgcggatcataaagttaaccttcgttgctgtgtttgatagggggttttacctgcactagcgaggtaattccacgactttattatcgatcaggcgggcctgaccaagccaggcggccatcaggatcaccgcacgtttactggcgggggaaacctccagcagcgtatcggcatcccggatctgaatatcatcggcgcgaaaaccgctgttattcagctcctgctccgccacggcaacgatctcatggatgtcgttatcgcccgcgagcagtttttccgccatcgcgttcatcaccttgctcagacccggcgcgattttgcgctgatcgctggtgagatagccgttgcgggaactcagcgcgagtccatctttcgcgcgtaccgtcggcacgccgatgatctcaatgtcataacccatgtcagcgaccattttgcggatcaccgccagctgctgataatccttttccccgaagcaggcgacatccggctgcaccaggttaaagagtttgctgacgatagtggcaacgccacggaaatgccccggacggctcgcgccttccagcatcgccgacaggcccggcacttccacccaggtttgcgactccgtgccctgcgggtaaatctgatccggcgcaggggcgaacacaatgtccactttacgcttgttcagcttttcacagtcgtcctgcagggtacgcggataacgcgccagatcgtcggcacggtcaaactgcatcggattgacaaaaatgctcgccaccaccacatcggcggcgtttcgcgcttcatccaccagcttcatatggccgtcgtgcaggttacccatagtggggaccagcgcaatgcgtttaccttcctgacgcagacggcggatatgctggcgcagcagcggcagggtttcgataatcaacacaataagactccttaatggaaactgtgctcttcgccgggataaactcccgcttccacctcttccacgtactgacgcaccgcagcgcgcatatcgccggtaccggtgaggaagtttttagcaaattttggaatatgtccgccggtaatgccaaaggcgtcgtgcatcaccaggatctgcccgtcggtaacattgcccgcgccaataccgatgaccggaatgcgcagcgcgtcggtaatgcgtttcgccagttcaaccggcacgcactccagcaccagcagttgcgcgcctgcggcttctaacgccagcgcatcgtcaaacagcgtttgcgcggcatcgccccggccctgcactttatagccgccgaaaatattcaccgactgcggggttaagcccagatgaccgcacaccggcaccgcgcggtcggtcaacatttttaccgtctccgccagccagcgtccaccttcaattttgaccatgttggccccggcgcgcatcacttctgcggaactggcaaacgcctgttcaggcgtggcgtacgccataaacggcaggtcggcgagcagcaggcaatgcggcgcgccacggcgaacggcgcgcgtgtggtaggcaatatcttctaccgttaccggcagcgtggaatcatgtccttgtaccgtcatccctaacgaatcacccaccagcatgacgttgatcccttcttcggcaaagagtttggcgaagctgaaatcataggcagtgatggtggcgaagcgctttttttcctctttacatttcagtagcgaggagatggtggttggtttcataacgtttcctgatggagccttcagacttccggcattctatcagtaacattgatgcgaacaatgattttagccaggctttcgccaggcgaaagcaaggggagatttaccagagggcgggttttggcgcgccgcactgcgtcagtacgcaggcgaggggcgtgccgtccgggaagagcgcttccggggcaatttcaaacagcggccacagcataaagccacggttatgcatgtcgtaatggggaaccgtcaggcgggacgtgttaatcacctcatcgccaaacagcatgatgtccagatcgagggtgcgcggcccccagcgctcggctttgcgtacccgaccctgcgccagctcaatacgctgggtatgatcgagcagggcttcggcatcaagcgtggtttcaagcgcgacggcggcgttcaggtaatcgggttgatcctgcgggccaaggggcggcgtgcggtaaaacggtgaaagcgcaacaatctggctgtgcgggatctctcccagcgccgtgatggccgcgttcacctgctcaagaggtgaggccagattgctgccgatagcgatatacgccagcgtcatgcgctgccttcgcggcgcggcgcgcgtttgcgcggacggcggtgacggcgacgttcctgcggttcgtcgtccagcacgtcgagcatgcctttttgcgccggtggcgcggatacctggaattcaccccaccactgcgtcagacgttgcagttcgtggttgttttccgcttcggcacgcagcgccatcaaatcgtaggcggcgcggaatttcggatgctccatcagcttccaggcgcgtttaccctgacgacgggacatgcgcagctgtagctgccagatatcgcgcaccagcgtggtaatgcgtttcggaatagccagcgtgcggcaggcttcgtcgagcacatcgttcatcgccagcgcaaaggcgtcgtgataggtcagcccgctttcctgggcgatgcgctgcgcggtttccagctgcggataccacagcatggcggcgaacaggaaggctggattgacgcgcatatcgttatgaatgcggttatcggtattcttcagcacctgatcgatgatgcgttccatcggcgtatcgccgctctcggtaaagtagcgggtaatggtcgggaacagcggctggaaaaggctgtattcgcgcagcagcttataggtttcgtaaccgtagcccgcctgcaaaagcttgagggactcttcaaacaggcgcgccggcggcacgtcgttgatgagcgtcgccaggcgcgggatcggctcggcggtttcgtcgctgatacgcatatgcagtttggcggcaaagcgcaccgcgcgcagcatacgcaccggatcttcccgatagcgggtttccggattgccgatcagacggatcacgccgtcttccagatcgcgcatcccgcccacataatcgcgcacggtaaaatcggcgacgctgtaatagaggctgttgatggtgaaatcgcggcgctgcgcatcatcttcgatggagccgaaaatgttatcgcgcagcagcatgccattctggccacgctgggaagtggtgcgatcggcagcctgctcttcatgatgcccgcggaaagtggcgacctcgataatctccgggccaaacatcacgtgcgcaagacgaaaacgacgaccgaccagacggcagttgcggaacagcttacgcacctgatccggcgtggcgttggtggtgacgtcgaaatcttttggctttttgcccagcaacaggtcacgcaccccgccgccgaccaggtatgactcatagccggctttattcaggcgatagaggaccttgagggcattttcactgatatctttgcgggaaatcgtgtgctgctcacgcgggataaccgtcatctttggttcggcgatggcgacgtcttcggccatgctctcctcgcggcttagcaccttgcggcaaaaattagcgactcgggtaaaaatagtgcacctcggttgtgtcagtcttctggacaaaaaaattgcggcttatcatagctcagcgtggggcatttgagaatgccggattcacgcaggcttgctccggcacccgtgacagggaccagttttgcaccgctcgttgtagcagggcgtccacggacagatcctgccattcttctgttacatcctgatttaaaaacgctaacgcgctgataagtatggggcgcgggtccccctgcggcagcgccggagcgtgattctgcttcgacagcttatcgccggcggcattgagcgccagcggcaggtggatatactccggcaccgcccagccaagcagttgatagagcgaaatctggcgtaccgtcggttcaatcaaatccgcgccgcgcacaatttccgtcacgccctggaaatgatcgtccaccaccaccgccagattatatgcaaataacccatcacggcgatgaataataaaatcttcatgcgccagcgccgcatcggcgacgatctcgccgcgcagccgatcgtgaaaacgggtcaccggttgatgctgaataagccgcagcgcagcgttttccgggccattgccccgcgtccggcagtagccgtcatagacgccgccaatgctctgaatacgcgccctggtgcaggtgcagtaatagcagcgctcttgttggtgcagctgttgcagaatgtcgcggtaggcgtcatgacgccgggactgccacagcacgtcgccatcccagtgcaaaccatagtgttcgagctggcgcagaatagtgttagcggcgccggggacttcacgcgggggatcaatatcttcgatacgtaccagccagcgaccggcatgggcgcgcgcctgtaaatagctgccaagggcggcgatcagcgaaccgaaatggagttcaccagaaggggatggcgcaaagcgcccgatataatcagcgtcaggcatggttgggtaaagctaagagggcgggagagactcccgcctgagagaacattacgaaagcgccgcaggttaacccgccatttgtttttcgcggatttctgccagtgttttgcagtcgatgcacaggtcagccgtaggacgggcttccaggcggcgaatgccgatttcaacaccgcaggactcgcagaagccgaagtcttcgtcttccactttcttaagcgttttctcgatctttttgatcagtttacgttcgcggtcacggttacgcagttcaaggctgaactcttcttcctgtgcggcacggtctaccggatcagggaagttagcggcttcgtcctgcatatgtgtgacagtgcgatcgacttcgtccctaagttgattacgccacgcttccagaatgcgtttgaaatgcgtgagctgggcttcgttcatatactcttcgcccggcttctcctggtatggctccaccccagcgatggcgagaatactcagggacgatgttttacggttttgcccttcttgcatgttgtttctccttaacacgcactatcgatccccgtgttggggaaaaatcaggccgctataaatagcagatgcttttcaggatagcaattatctaaacgttacacttgacaaccctgtgaggaaaagcgtatttgcgcacgtaggccagcacactatttactcagccactatacctttaaaattcggcagatagcggcattgtcagactcataatttcggcagaaagttccgctttataaatcagaatttctaccccctgccgctgcgcttcactgagaagctgtgcgtatttaggatcaatgtggcgagccggtgaaaatcggtcaatggctgaatgcagcacggcaaacaacagcactgcccgatcccctgcggccgccacgctcatcaactcacgcagatgcttctgcccccgcagcgtgaccgcatcggggaaatagccctgcgccttatcggccagcgtgactgatttcacttcaatatagcagttgcggcggtcttctgcctgtaacatgaaatcaatacggctctgctcagaaccatatttcacttcacttttcaaagtgctatagcccgttagtgttggcaaacgatctgccattaatgcctctttcactaacatattggcgcgcaaagtattgacgcaaatccacgcgcccgcttgcgtttgagttaattcccaggtgtgtgcatatttccgtttagtattttctgaagtggaataccagacggtgtcgccaggcgtcgcgcaaccggtcatcgcgccggtattcgggcagtgcagggtcagggtttcacctgtgggcgtcaccacatccgccagaaagcgtttataacgctggatcagggtggcggactgaagcggcggagaaaactgcataggtcattccttttggctgagcgtccagcggctgagcgccgtgtaacgcgtacgtcccttaataaactgcgattcatacagcacaaattcattcaccggaaacgaccagcgaaagcccggcggcggtatagtgaccgcatggctggcgtcgcgcagcagcgtaacgtgcgggtgaaacggctgcgggctttgatagcatccactgcgggcggcctgcgcgcgcagcatactcgccagttgcagcaggccccgcggcggctgacgggtaccgagccagacgacccgcgagcgcagccactgtccggcatcatcgagcgtcagcgtaaagcctggctggcggatacgcccggccagctcgcacaacgcccgctgtttgtcagcgctcacatcgcctaaaaacgccagcgtcaggtgcagattagccgccgcgatcgggcgaccggcgtccggagcaaagtgcgcggcgcgccagtggatcacctgctgctgtacgtcagcgggcagttcaaggccgaaaaacagccgtctggtatctggcataagggatactcggtaatgatttacggcgatgctacaatgcacgccgatgaaatgaaagttaacccactggagccctgcgtgtcctctttgccggttgccgccgtactgcctgaattgcttgccgcgctgaaaagcgcctcctgcgtgctgcttaatgcgcccaccggggccgggaaatccacctggctgccgttgcaaattctgcaacagggcgagattgcaggccgcattttactccttgagccgcgccgactggcggcgcgtaacgtcgcgcagcggctggcggaaagcctgaatgaaaagcccggcgacaccgtcggctaccgaatgcgtgccgaaacctgcgtcgggccgcagacccgcctcgaagtggtcactgaagggatcctcacgcgcatgatccagcaggatccggaactgaccggcgtggggctggtgatcctcgatgaattccacgaacgcagcgtacaggcagatctggcgctggcgctgctgctggatgtgcaacaagggctgcgggacgatctcaaattattgattatgtcggcgacgctggataacgaacggctgcgcgggctactgcccgatgcgccggtgattgcgtccgaaggccgcgcgtttcccgtggaacggcgctaccagccgctgcccgcgcatcagcgtaccgatgaagctatcgccattgccaccgccgaactgctgcgggcggagcgcggctcgctgctgctgtttctgccgggcgtcggcgagatccagcgcgtgcaggaacacctcgcctcgcgcgtgggtgcggatgtccagctctgtccgttatacggcgcgctgccgctggccgaacagcgtaaagccattcttcccgcaccggaggggctgcgcaaagtggtgctggcgaccaacattgcggaaaccagtctgaccatcgaaggcattcgcttagtggtggacagcgcccaggagcgggtggcgcgtttcgatccccgtaccgggctgacgcggctggtgacccagcgtatcagccaggcgtcgatgacccagcgcgcaggccgcgccgggcgactggaggcggggatctgcgtgcatctgctggcaaaagatcaggcggaacgcgccgccgggcagagcgaggcggagatcctgcaaagcgatctctccggtctgctgctggagttgctgcaatggggatgcccggatccggcgcagctgtgttttctggatgcgccgcccgccgcgaatctggccgcagcaagaacattactgacgcagctccaggcgctggcggacgatcgcctgaccccgcgcgggcagaaaatcgcgcagctcggcaccgatccgcgtcacggggcgatgcttatcgccgcgaacacgccggataagatcgccaccgccgcgaaactggtcgccattcttgaagagccgccgcgtggcgggaatagcgatttaagcgtcgccttctcacgcagtcagccgcactggcagcgccgcagccagcagttgattaaacgcctcaacgcgcgggcaggcgcggaggacagcgatctgctccccggtctgctggcctgtggttttgctgaccgtatcgcccgccgtcgcgggcaggaaggacgctaccagttggcgaatggcatgggcgtgatgctcgacagcgacgatgcgctggggcgtcatgagtggctgatcgcgcccttgctgttgcagggcagccatacgccggacgcgcgcattttgcaggcgctggcgctggacattaatgcgctggtcaccgcgcacccggaattattacgccagtctgatacggtggaatgggatgacgtgcagggcacgctgaaagcctttcgccgcagtcagattggacagctaacattaaacgtcaggccgctggcgaaaccgtcggaagaagagctgcatctggcgatgctcaacggcatccgcgagaagggcttgcaggtgctgaactggacgccggaagcgcagcaactgcgattgcgtctgcactgcgctgcaaaatggctgccggaaacggcatggcccgccgtggatgatgactcgcttttggcaacgcttgagctatggttacttcccggcatgcagggcgttcactccctgcgcgccctgaaagcgctggatgtgtgccgggcgctggaaaatttgctgagctggccgatgcgtcaacggctggatagtgcgctgccgtcgcattacactgtgccgacggaaagccggatagccattcgttatcacgaggataacgacccggtgctggcggtgcggatgcaggagatgtttggcgaggcgaccacgcccgccattgccgacgggcgcgtgccgctggtgctggagctgctgtctcccgcccgccgtcccttacagatcacgcgcgatctcagcgcgttctggcagggcgcgtaccgtgaagtgcagaaagagatgaaagggcgctatcccaaacatgtctggccggatgacccggcaacggcagcgcccacccggcgtactaaaaagtattcacaggcataatcacatcctgtaggccggataagcgtcagcgccatccggcacgagtgcaatgaactttgagagatttcttcttccgccattttgcggaagcaatgaggatcgggccttgcgcctgaaaaatgtagcggagagtaaacatggcggggaatgaccgcgaacctattggacgcaaaggccgacctgcgcgtccggtaaaagaaaaagtaagccgtcgtcgactcagagatgaagacgcggatgattatgatgatgaggacgacgaaccgatgccgcgccggactaaaggtaaaggcaaaggcaaaaaacctcgcggcaaacgcggctggttctggctgctggtaaaaatcggcattgttattcttgtactgctggcgatatacggcctgtatctcgaccagaagatccgcagccgcattgacggcaaagtctggcaattgcctgccgccgtgtatggccgcatggttaaccttgagccggacatggcggtcagcaaaaacgagatggtgaagctgctggaagccacgcagtaccgcaaggtgacggcgatgacccgccccggcgagtttaccgtgcaggctaacagcatcgagatgatccgccgtccgttcgatttcccggacagcaaagaggggcaggtgcgcgcgcgtctgaccttcagcggcgaccgtctggaaaccattgagaacatggagaacaaccgccagttcggtttcttccgtctcgatccgcggctgatcaccatgctctcctcgccgaacggcgagcagcgcctgtttgtgccgcgcagtggtttcccggatctgctggtggataccctgctggcgaccgaagaccgccatttctatgagcatgacggtatcagcttctactccatcgggcgtgcggtgctggcgaacctgacggcagggcgcacggtgcagggggcgagtacgcttacccagcagctggtgaaaaacctgttcctctccagcgaacgctcgtatggccgtaaagcgaacgaagcttatatggcgctgatcatggatgcgcgctacagcaaagaccgtatccttgagctctatatgaacgaggtgtacctcggtcagagcggcgacaacgagatccgcggcttcccgctggcgagcctgtactacttcgggcgtccggtggaagagctgagccttgaccagcaggcgctgctggtgggcatggtaaaaggcgcgtccatttataacccgtggcgtaacccgaaactggcgctggagcgtcgtaacctggtcctgcgtctgctgcaacagcagcaggttatcgatcaggagctttacgacatgctgagcgcccgtccgctgggcgtgcagccgcgcggcggcgttatttccccgcagcctgcctttatgcagatggtgcgtcaggagttgcaggcgaagctgggcgataaagtgaaagatctctccggcgtgaagatcttcaccacctttgactcggtggcgcaggacgccgccgagaaagcggcggtggaaggtattccggcgctgatcaagcagcgtaagctgagcgatctggaaaccgcgatggtggtggtcgaccgcttcagcggcgaagtgcgcgccatggtcggcggagcgacgccgcagttcgccggttataaccgtgcgatgcaggcacgtcgttccattggctcgctggcgaaaccggcgacctatctgaccgcgctgagccagccgaatcagtaccgtctgaatacggtgatcgccgatgcgcctatctccctgcgccagccaaatggccaggtgtggtcgccgcagaacgatgacaaacgcttcagcggccaggtgctgctggtggatgcgctgacccgttcaatgaacgtgccgacggtaaacctcgggatggcgcttggcctgccggcggtcaccgatacctggctgaaactgggcgcgccgaaagatcagctgcatgcggtgccatccatgctgttaggggcgctgaacctgacgccggtggaagtggcgcaggcgttccagactatcgccagcggcggtaaccgcgcgacgctctcttcgctgcgttcggtgattgcggaagacggtacggtgctctaccagagcttcccgcaggcggagcgcgcagtgcctgctcaggcggcctatatgacgctgtggaccatgcagcaggtgatccagcgcggcaccgggcgtcagcttggcgcgaaatatccgggtctgcatctggcgggtaaaaccggcaccaccaacaataacgtcgacacctggtttgccgggatcgacgggcgtgaagtgaccatcacctgggtaggccgcgacaataaccagccgaccaaactctacggggcgagcggggcgatggccatctatcagcgctatctggcgaaccagtcgccgttcccgctggagctgaccgcgccggaagacatcgtcgatatgggcattgatgacgcaggcaacttcatgtgcgctggcggaagttcccgtactatcccggtgtggaccaccaacccggacagcctgtgccagcagagccaggcgttgcagcagtcgaataatccgttcgatcagtctgcgccgcagcagccgcaacagcagcctcagcaacagcaacaacaaccgccgcagcaggaagaaaaaagcgacggcgtagcgggctggatcaaggatatgttcggcggtaactaagcgttacccgcctgtatcaccgcctcagagtcgattaacgtcgctctggggcgttttttttaagattgttccctgcttattcctcccggtcatgctttccatttcctaatgtatgccacttccttatgacgtcacaatcccggtgattaaacgggagttatattcattcaaccatagctttcatgtattaactctctgatcccgggtgtagtgggacattactatttttctggtgaatatatggaataaaatttaataattaattaaatcttgtataagactaatcaaaagcatttttaatatgagtcttccttgtcagggtcttaaatatttgctggcttcaggaaattcctggtggttgcgttaactttcaggtgaaggtaatattagtaaataagatcgaatgaacgtgaggtgtatatggatatcttttcacttcataagctcattcttatggttggttaaaatattaactccccggtttatcatttttgtgatgtaaatttttttatagacatatgtaaggaacacgttatgtataaaaaatattttctgccactgcttgctggcgcgctgtttactacctccgtttcgccagttcaggcgaccgataccggtactattagctttaacgggaaaatcgtcgccgacagttgcaacgttaacgtgaacggcgcagtcactaacggcattgtgacgttcaggaacctgacgcaaacttcatttggcgaggataaaaaagtgggtgatagccagccttttaagattaccgtacgcaactgcgataccagcatctcttttattaacatcaagttctccggcgatcgcatcgcaggttatgacgatgaagttctgggaaccaccggtgttgccaataatgtagggatccgcatgtacccggaatacagcagtaacacctttattaaatttgacgggacagaaccaccctctgccgcaaaacaaaatgtgcaggggatggacgtcgtatttaactacaccgctgaagttattcaggttggtgcggatttaccgactgcgggtgattattccgcgcaagctacatacaccctggtttatcgttaatttatcaagataaactggcccagggcgggccagtattttcaatggaatgaaggaaatgcgaatttataatgccatactcgggatcttctttctgctgggcgctaccctggcgcaggcgggcgtcgtcattggcggaacgcgaattatttatccctcagaccaggctgaagtccaggtcacgttaaaaaataaagatgatgctaagcgttatctggtgcatagctgggtcagcaatattgatgacagcaaagcgccctttgtcatcacgccgcccatttacaagctcgatgaaaatcgtcaaacgctgctgcatgtcgtctataccggcgataaaacacatttaccccaggatcgcgaatccttgtttatggcaaatatcaaatcggtgtcttctgtgcctgaagaactgcgcgataaaaatactctgcaatttgcgatcaagacgaaaatcaaactgttttatcgcccatcggcattaagcgatgccgccgcgaaaacggcatggcagtcgttacagttcagccgccgcaataatcagttgacgatcaaaaaccccacgccgttttacgttaccctgggccagcttaaggtggcgcagaaagaggtaaaaccgctcggcaagcaggataccccttccgcgctatccatgatgatcgccccttatggcgagcaggtttttgccctgccgacggcggcgcaggggtcagtgatgtggaccgcgatcaacgattttggcgccgagaccgaaccgcgtcagcaagcgttataacctggctgtgaatttatcgtgggtggcgtttatgtcttcctggcgtaatggccggatttttgggctgagcgcgctggcactggcaatatcaacggtgaccagcgccgtgtatgctgaagactatttcaacctcggcgcactggaaacagagacacccctggaaaataccggggctattgaagcctggctgcgtaataacggcttgacgcctggccagtatctgacgtctatcgtctggaatgaggatcgccttgataaaagaaacctcaattacctcctgtcgaaagacaataaacaactcattccgcaatttaccaaagccgaactggctgaactgggcgtaaaggtcgataccgttccggcattacatgagcttgcggataatgcgacggtaggcgacatcagtgagtacattcctggggcacgttatgatttcagtccggacacccaggtgttgcaactgcatatcccccagatgtatcgcaatacgcggatctcaggcgaaactaatccggcaaactgggatgacggtatgcccgcaatctggtccagttattatgtttctggcgcgcgtcagcaatctgaatccaccagcagcgtggcaaactgggcaagcctgaactccggtctgaacatggggccctggcgcgtacgtaataccagtagctgggcgagtgacactggctggcagtccatcagcagcacccttgagcgcgatattaaacgcttacgcggccagtttcgcgccggacagacctcgactaacggcgagctgttcgacagcgtgcagatgacaggcgtaaccctggaaacggacaccgctatgttgccaggcggattacagggatttgccccggtagttcggggtatcgctaacagcgacgcgaaggtgaccgttaagcaaaatggttacatcatttatcagaccaacgtctcggcagggccttttgagctgcgcgatctcacgcaggtgacggcaggcgccgatctcgaagtgacggttgaggaagccgatggtacacagcgaagctttatccaggccagttcgtccgttcccatcatgcagcgtgaaggcgcgctgaaatacagcctttcagcgggtaaataccgcgatgttaatcatggcgcagagccgggctttggtcaggcgacggtgatttatggtctgccattcggcacaacggtttacggcggcgtacttggcgcctctatgtatcgcgccggtttggttggtgtgggagccgatttgcgccgtctgggctccctgtcgctggatctgacgcaggcacacacttcttttacagatgaacgtggcgataagaaggggcagtcatggcgtgcgcagtacgcgaaagactttccggcaaccgatactacgctgacgctggccagctaccgctattccacgtctggcttctacacttttcaggaagccctggatcagcgcaatggcggctatgacagcagcgatatgtacagctatcgcaacgtctacaacagacgcagccgcttgcaactcaatctttcccagtcactacggggatggggttccgtctatgctaacacctggcagcaaaactactggggaatggcggggcgcgagcgcagcgtcagctttggctacagcagcagctggcacggggcgaactggtcagtgaattacagcctgaccaaaacgcccacgacccgtgacgaccggcaactcgctctgtcactgaatattccgctgtcacgctttttgccggaagcctgggccacttacagtctaaacagggcgaaaaatggccccgcgtcgcaccaggtgggtcttaacggctcgttgctggaagacaataacttgacctataacctccagcagacctacaccagcgaccaggctggcaatggcgcttatctctcctcccgctatcgcgcctctatgggcgatttcagcaccaactacagctaccagaaaaacagtaaacagtggggatatagcgcacagggttcagtggtggcgcattcccatggcgtaaccctggggcgtacggtgcaggacgcttttgccgtggtgcatattaccgatggcgatcatgtgaaagtgcagagttcacagggcatttataccgacgcctggggcaacgccatcgttcccacgctgaccccttaccggcgcaataccattacggtgaacacgcaggggcgggatgatattgatattcaggatgccgcggtcgaagccattccgacaaaaggggccgttctggcagccgatttttccgcccgctcgggtaaacgcgcgctgttaaccctgacgcaccgtgagggcgtagtgccattcggcgcggtgttcagtatcgaaggcatgacggcgattgtgggtgatggcggtgaggtctacgtgacgggattaaagggtacgcaagcgttcaccgtgcaatggggcgatacgccggagacgcgctgcgcaggcaggatcaccgtgccgaaaaaaatggatgccaggtttctgatgagaaccgtcagctgcgaataaacaggacgttgagatgaaaaataaaatgttgttaatggcagggcgctgcggtcttgggttgctgctgatcggttcggcgttattgagtacggccgcgcgggcgtcgtgcaccattcttgacagaaaacctgctgcaaggattggattcgcgccgccgacattaatcgtcaacagcgatgctgaacctggtacgatcatttatagcgagcgtcagtccagctatacgatcagagttgaatgtactgccgttgcggacatctggcagggttataccaatgtcaacgcaactgacgagcgggcggacaatcccctgcagggcgtctatcaaaccaatgtgccgggtatcggctttcgcgccgcctggacaaacgcgactacgccaacattcgaagccgacgatatcgtcaggccctggcacagagatatgtcgcctgttatcaaagagaatggctattacaccttaacgctcaacggcgcggcgcagtttgtcgtgaccgggccggtgagttcggggatggtgtacatcggtaaatttaatgccgaatggaagtacgataacaccgtcgtcggctacctgagctacagctccagcctcgttgaagtgcagcacacgacctgtaatctggtggaaaaaaacatcaccgtgcctttagaggagattaatgcgagtgagtttacaaataatgtctcaagggtggtatccgatgacaggtttaagctccagattgataactgcgacgccggaagaaaaatcgattaccgcttcactaccgcaggttcgactggcgtgacaaacggcaatatcctgaatattgcggcagaagaaggggccgctcagggtgtgggtatccagatcctgaacagtaataatgcggtgttgcagtttgaccaggagtatacggcggtgtcacaaaccagcgccgggcagtcggtcactatcccgctaaaagcgcgctatatcaaaaccggcaccgtcaaaggcgggcatgtcaacgcggcggcgacttttgaggtttactatcgctgaaatgtgaactttgcatgggttattaaacattcgggcacatcttttttaccctttctgatcatctgattatttcttaaaccctcaattcttgtagggccgcatatcccttgctttcaagccggatgctcgcataatatgctgcggtcataataataattatcgtttacgttatcattcatcccattccagagagacacacaatggcgcgtcctgaaacggctctgccggtcaattcttcactgcgtaaaatcgcagtcgtggtcgctaccgcaatcagcggcatgtctttttatgcccatgcagctgaagacactattactgtcaccacctccgccgccccgcaggaaagcgcgtggggcccggcggcgacaattgctgccaaacacacggcaacagcaaccaaaaccgatacgccgattgaaaagacgccgcagtcgatttcggtggtaacgcgtgaagagatggatcttaaacaacccggcacggtaaaagacgcgctgagctatacgccgggcgtattcgccacgcgcggcagctccaccacttttgatgtggtgtctatccgtggtttcaccacttccacgacggtgaacaccaaccagtatctcgacggcatgaagctgcagggtgataactactctgaagcgtccatcgatccctatttccttgagcgtgtggaattgctgcgcggcccggtttctgtgctgtacggcaaaagccatccgggcggcgtggtcagtatggtgactaaacgcccgacgacggaaccgctgaaagaagtgcagttcaaaatgggcacccacaacctgtggcagacgggatttgatttcagcgatgccattgatgataacggcgaattctcttaccgcttaaccggtctgggccgtagccagaacgcgcagcaggagaatattaaatccacacgttatgccgttgcgcctgccttcagctggcgtccggatgacaaaaccgacttcaccttgctgagcaatttccagagcgatccggatgcaggctactatggctggttgccgcgtgaagggacggtggtgccgtattacgatgccgccggtaacgcgcacaagctgccgaccgacttcaacgaaggtgagaaagataaccgcctgtcccgtcgtcagcagctgattggctacagttttgcccatggctttgacgataccttcacggtgcgtcagaacctgcgttacacccgtgtccatacgctttatacctcgacatacggcaacggctatcaggcaccggcgcaaatcaatcgcgcctttgtgcgctccgatgaagatctgaactccttcaccgtggatacgcagctgcagtctgatttcgccaccggcgcggttgatcatactctgctgaccggtgtcgattacctgcggatgcgtaacgatattgatgcggattatggcaccgccaatccgatcagcatgaccaacccgcagtacggcaatgcgaacgtcaatatcaacttcccgtatgcggtgatcaaccgtcaggaacagacgggcctgtacgtgcaggatcaggcggaatggaacaaatggatcctgaccttaggcggtcgctacgactttgcgaagacctccacctttacccgctcttccggtacgctggctgaaatcaacgatgagcagttcacctggcgtggtggcctgaactatgtgtttgataacggcattgcgccttacatcagctacagcgaatccttcgagccgatttccggttcgacccagggcggtaaaccattcgatccgtcccgcggcaagcagtatgaagcgggcgtgaaatacgtgcctaaagatctgccggtgacggtgacggcggcggtttatcagctgaccaaggacaaaaacctgacggcggatccggcaaataccgccttcagcgtgcagggcggcgagatccgctcgcgtggtttcgagttagaagcgaaagccgcagcgacgcaaaatatcgatatcacggcgtcctacacctttaccgatgcggaatacacccacgacaccctgtttgaaggcaaacgtccggcggaaatcccacgcaacatggcttcgctgtgggcagactacaccttccatgaaacggcgctcagcggcctgaccgttggcgcaggcgcgcgttatgttggcaacaccaccagtttctacggcagcggtccgaagacaaaccagacctttaacgtagcgagctacacggtggctgatgcgatggtgaaatacgatctggcgcgctttggcctgccggggtcgtccattggcgtgaacgtcaacaacctgtttgaccgcgaatacgtctccagctgctaccgcgatcacgcctgttactggggcgcggaacgccagattgtcggtaccgcaaccttccgcttctaatctccttttgggcacggcttgccgtgccctttttacaagttggcgctatgcaggaaaacaactcccatcccgataccacgtttcgtcttaccgatgtcgccttccgggtgcctggccgcacgctgctgcacccgctgtcgttaaccttcccggtgggcaaagtgaccggtcttattggtcataacggttccggtaaatccaccctgctgaaaatgcttggccgccaccagccgccgtcggacggcgatattttgctggacggacaaccgctggacagctggaacagcaaagcctttgcccgcaaagtggcctatctgccgcagcagttgccgcaggcggaaggcatgacggtgcgcgaactggtggcgatagggcgttatccctggcatggcgcgctggggcgttttggtgtcgccgacagggaaaaagtcgacgaagccattgcgctggtgggattaaaaccgctggcgcaccgtctggtggacagcctctccggcggcgagcgtcagcgggcgtggatcgccatgctggtagcgcaggacagccgctgcctgctgctcgacgaaccgacctcggcgctcgacatcgcccatcaggtggatgtgctggcgctggtacaccgcctcagccagcagcgcggcctgacggtgatcgccgtgctgcacgatattaatatggcggcgcgttactgcgattttctggtggcgctgcgcggcggggagaagatcgccgaaggcacgccggaatcgctgatgcgcgccgatacgctggaaaaaatctacggtatcccgatgggcattctgcctcacccgacaggggctgcaccggtgagctttgttctctgatgactgacgtaaacctctttagccgtcgccgcctgctgacggcgatggccctgtcgccgctgctgctgaaaatgggcagcgcccgcgcggcggctgtcgatccgcatcgcatcgtcgccctggaatggctgccggtggaactgctgctggcgctcggcatcaccccctatggcgttgccgatgtgcccaactacaacctatgggtcaacgaaccggcgctgcccgactcggtgatcgacattggcctgcgcaccgagccgaatctcgaactgctcacccagatgaaaccctcgtatatggtctggtctgccggctatggcccgtcggcggatgtgctggcgcgtatcgcccctggccgtggattcaccttcagcgacggcaaaaagccgctcaccatggcgcgtcagtcgctccaggaaatggcgcagctgattggccgggagccagccgcgcgggcgcatctcaatgaattcgatgcttttatcgattcgatgaaaccgcgctttgcgaagcgtggcgacaggccattactgatggtcacgctgctggatgcgcgccatatgctggtgttctgcccgaactgcctgttccaggagccgcttgacgcctttggtattcctaatgcctggcagggggaaaccaccttctggggcagtacggcggtgggtatcgaccggctgggcgaatttaaagatgtggatgtgctctgtttcgatcacggtaacgagcgggatatgcaggcgctgatggcgaccccgctatggcagtcgatgccttttgtgcgcgccggacgcttttatcgtgcgcctgcggtgtggttctacggcgccaccctgtcggcaatgcactttgtccgcgtgctggataaggtgatgggaggccaggcatgagccgtcgtatcgcgcctttcccggcggcgctgcttgccgtgctgtttatcgtcggccttggcctgacgtggaataacctcaacgtggcgctgccccgtgcgcagtggcagcagggtgtctggcaaccggatagtaattccattgagcagatgctgttccattacagcctgctgccgcggctggcgatttcattgctggtgggcgcaggactgggactggtgggcgtactgttccagcaggtgctgcgtaatccgctggcggagccgacgacgctgggcgtcgctaccggcgcgcagttggggatcaccatcaccacgctgtgggcgatgccgggggtgatgacctcgcagtttgccgcgctggccggggcctgcatggtgggcgcgctggtatttggcgtcgcctggggaaaacgcctctcgccggtgacgctgatcctcgccgggctggtggtcagtctgtattgcggggcgatcaatcagctgctggtgctttttcaccacgaccagctgcaaagcatgttcctgtggagcaccggcacgctgacgcagaccgactggagcgtcgtgcaacgcctgtggccgcagttgcttggcggcgcgctgctcacgctgctgctgctgcgtccgctgacgctgatggggctggatgacggcgtggcgcgtaacctgggcctggcgctgtcgctggccagacttggcgcgctgatgctggcgattgtgctcagcgcgctgctggtgaacgcggtgggtatcatcggttttatcggcctgttcgcgccgctgctggcaaaaatgctcggcgcgcggcggctgctgtcgcggctgctgctagccccgctgattggcgcgctgatcctctggctctctgatcaaatcgtgatctggctgatgcgggtgtggatggaaatctccaccggatcggtgacggcgctggtgggtgcgccgctgctgctgtggctgctgccgcgtcttaagagtatgaacgcgccctcaatggaagggggcgatcgcgtgtttactgagcgtcagcatgtgccctggtttgcgctggcgggcctcatcgtgctgctgctcggtatggcggcagcgctgtcgctggggcgggatgcagaagggtggcactgggcgagcggttcgctgctcaatgaactgatgcagtggcgcgcgccgcgaattctggcggcgctgacggcgggcgtgatgctggcggtggcgggctgcattatccagcgcctgacgggtaacccgatggccagccccgaagtgctgggcatcagctccggcgcggccttcggcgtggtggtgatgctgttctttgtgccgggcaacgcctttggctggctgctgccggcgggcagtctgggggcggcagtgacgcttatgatcattatgctggccgccgggcgcgggggattctcgccgcaccggatgctgctggcggggatggcgctcagtaccgcctttaccatgctgctgatgatgttgcaggcgagcggcgatccgcgtatggcgcagatcctgacgtggatctccggctcgacctacagcgccaccgccacgcaggtgatgtgggcgatggcagcgaccgttgtactgctggcgatcgcaccgctgtgccgccgctggctgaccattctgccgctcggcggtgaaacagcccgcgcggttggcgtggcgctcacgccgtcgcgcgtcgggctgctgttgctggcgtcctgtctgaccgccgccgcgaccatgaccatcggtccgctgagttttgtcggcctgatggcgccgcatattgcgcgcatgatgggcttccgccgtacaatgccgcatatggtgatgtctgccttaacggggggattactgctggtgtttgcggactggtgcggcaggatgatcatgttcccgtaccagatcccggcggggctgctgtcgacctttatcggtgcgccgtactttatttatttgctgaggaagcagagccggtgagacgtgccgggtggcggcagcgccttacctgacgatggttttgtcgggtggcgctacgcttacccgacctacggtactgcgattctgtaggcccggcaagcgaagcgccgccgggcacaacaacaactaaagctgtgcaaacaccttacgcgccgcatcaatcgtcttattgatatcttcttcgctgtgcgccaccgacataaagcccgcttcgaacgctgacggcgccaggtaaacgccttcgtccagcatcagatggaagaaacgcttaaagcgctccacgtcgcacttcagcacatcctgatagcaggtcacttcggcggcatcggtgaagaagatcccgaacatgccgccgacgtgattcaccaccagcggtacgcctgcttcctgcgccgcgtccagcagaccattcgccaggcgggtggtcagatcggtcagggtttcgtggataccaggctgggcgacttccgttaaacaggcgtagcctgccgccatggcaatcgggttgccggacagcgtacccgcctgatacaccgggccggtcggggccagcgcatccatcacctcacgacgcccgccaaaggcgcccaccggcatgccgccgccgatgattttgccgaggcaggtcagatccggcaccacatcgtagtaagcctgcgcgcccgccagcgccacgcggaacccggtcatcacttcgtcgatgatcagcagcgcgccaaactcatcgcacagcgcgcgcaggcccggcaggaagtccggctgcggcggaatgcagttcatgttgcccgcgacaggctccacgataatgcaggcgatctcctgcgggaactcctcgaacgcctgacgcacagacgccagatcgttataggtgcaggtcagggtatgcttcgcaaaatccgccggtacgcccggtgaattcggctggccgagggtcagcgcgccggagccggcttttaccagcaggcagtcagcgtgaccgtggtagcagccttcgaatttgatgattttgtcacgaccggtgaagccgcgcgccaggcggatggcgctcatggtggcttcggtaccggagttcaccatccgcaccatgtccatggtcggcaccagttcagttaccagcgccgccatttttacttccatttcggtcggtgcgccaaagctcaggccgcgctccgccgcttcgataaccgcgttacggatcgccgggtggttatgccccagcaccatcggtccccaggagccgacataatccacataggctttgccgtcggcgtcgtacaggtaagcaccatccgcacgctcaataaacagcggcgtaccgccgacgccggtaaacgcgcgtaccggcgagttcacgccgccggggatgagtttacgtgcggcgctatagaggtcttgagacttactcataagtgagttcctggttcgtggaaaaagggtttatgggccattctaaagtattcgccggaggttataaaagtttcccccgattgaaagggcacttttgtgggtatttttattgccaccatggcggtgcgcatgggtaaaataggccaactcatttgtgtgacgaattaattaagccaatatgaaagcagaaaattcttccttccgcacacagcaactggtgcgtttgcggcgcggcgatctgatccgccgtctgttgcagcgcgacaaaacgccgctggcgatactgctgatggcggcgctggtcggcaccctggcgggactggtgggcgtggcgttcgagaaagcggtgaacggcgtgtcaaacctgcgcatcggcacgctggcgcaggtggcggatcgcgcctggctggtatggccgctggcctttgtgctgtcggcactgctggcgatggtcggctattttctggtgcgacgcttcgcgccggaggcgggcggctcgggtattccggaaatcgagggcgcgctggaggagcttcgcccggtgcgctggtggcgcgtattaccggttaaattcatcggcggtatgggtacgctgggcgcgggtatggtgctggggcgcgaagggccgacggtacagcttggcggcaacgtcgggcgcatggtgctggatattttccgcatgcgcagcgccgaagcccgccacacgctgctggctaccggtgcggcggcggggctgtcggcagcgtttaacgcgccgctggcaggcattttgtttatcctcgaagagatgcgcccgcagtttcgctataacctgatttccataaaagccgtgtttaccggcgtgatcatgtcgagcattgtgtttcgcatttttaacggcgaaggggcggtgatcgaagtgggcaagctggcgaatgcgccggtgaatacgctgtggctgtatctggtgctcggcatggtcttcggctgcgtcgggccgctgtttaatacgctggtgctgcgcacgcaggatatgttcgcccgtctgcacggcggcaatattaaaaaatgggtgttgatcggcgggattatcggcgggctgtgcggtgtgctggggctgattgttccggaaatttccgggggcggctttatgctgatccctattgccgccgccggaaattacgcggtgggcatgctgctgttcatctttgttgccagggtgatcaccaccttattgtgcttttcatccggcgcgccgggcgggatattcgcgcctatgctggcgctgggaacgctgttaggcacggcgtttggtatggcctgcgccgggctgtttccggcttatcatctggaggcgggcaccttcgctattgccgggatgggcgcgctgctggcggcttccgtgcgtgcgccgctcaccggcatcgtgctggttctggagatgactgataattatcagctcattttgccaatgattattacctgtcttggcgcaacactactggcacaatttttaggcggcaaaccgttatactcgaccatccttgcccgtacgctggcgcgtcaggaagctgaccttgaggctaagacccacgcgcaggcattcagggagaatacttgaacgattcaccagggtattagataataatttaaagatcgggttaatttttgcccgcatcgccgtatcattgggagcaaaaaatgagtgatgaagtagccctgccgctgcagtttaccgaagccgcagccattaaagtaaaagatctgatcgcagacgaagacaacccgaacctgaagctgcgcgtctacattaccggcggcggttgcagcggcttccagtacggtttcacctttgacgatcaggttaacgatggcgacatgaccattgaaaaatccggcgtcgcgctggtggtggatccgatgagcctgcaatatctggtgggcggcgcggtggattataccgaaggtctggaaggatcgcgctttgtcgtgaccaacccgaacgccaaaagcacctgcggttgcggatcgtccttcagcatttaattctctgctctgttgtcgggcggcgacgccgtctcgcccggcctgcaaaacatcatcacattattttgtaggcccggtaagcgtagcgccaccgggcgaatcatgacagttccaggcccggtaagcgaagcgccaccgggcaatatcatgtcttatcgcggattatcatccagcgcaaaggtcggcagtttcagatgccagcggatcgccgccagacgaatggcgagcgtcaccaccatcccgatcatactcgccgtttccagcggtacgccgaaagtataaaacgccgtcgcatgcacgatgccgccgataatacaggctgtggcatagatttcggtgcgcaggatcattgggatttcccgcgccagcatatcgcggataataccgccgcccacgccggtgaccacgcccatacaaatcgccaccagcggcccggttccggccagaaacgccttattcacgccaatccccacgaagaccgctaaccccacggcatcgaacaccggcaatacccatttcggcaggcggcgcggctggcgcaccagcagaatggttaacaggcaggtgaccatagcgatcaccagatcggtgggatcttttacccagaacaccgggccgtgatccagcgccatatcgcggatggtgccgccgccgacggcggtcaccacccccagcaccagcacgccaaagggatccatacgcagtttgccggcaagcagtacgccggagatggcgaaaacggcggtgccgataatatccagccagtagacaagcattttattttacctgtgcgagagcggtacagagttgttttgcggcgaggataatacgcggggatgcacgttcaaaccagtcactattgagggctatcacctcacttttgagatgattattccagaatgcctgcactttcggaatggcgtccactccgccggtgaccacaatggcctgcggatcgcgggccagcacctgttcacggctcacctgcggccagggaacacgggcggaagcaaagatattttcaccgccgcacagcgtcaccacctggtgctggatggttccgctgccgctggtaaacagcgggtgagtgctgaactgcataaagacgcgtttcttcggcgtaccggcgtactgcgcttttaaggcggcataatcggtgagcatcgcctgagcactggcgtgcgcctgttcgggttgcgggctgtattcggcgaggcgctccagcgattgcgccacctgctcgatgctttcggcgtcaacccacagcacgcgaataccaaagcgggtgagctggttaacctgacgttccgcgttgccgccgcgccaggccagcaccacgtcgggcttaagcgccacgatgcgctcaaggttaatgccctgccagctggcgacctgctcaattttactggccgcgggcgggtaatcggaatggctgctgacgcccgccggcgtgatcccggcggcaaacgccagttcagtattggccggtgagagggaaatcacgcgcggcgcggcataaagccacgctggcgtcagcagaagcagggcggcaagcgccctgaaggaacccttagccacgcgccaggttctgcaccagcgtctcaaccatcaggctggactgcttcgccgccacgacgaggaattcctcgaagctcaggtgcgactcctgatccgccacgtcagaaatggcgcgtaccaccacaaaaggcacgcccatgttatggcagacgtgggcaatcgccgtggcttccatctcaacggcaatcgcctgtgggaagttatggcgaattttcgcgaggttttcggaaccattgataaaggcatcgccgctgacaatcagcccgcgcacggcgttcaggtttaattgcgcaatgcaggcttcggctgcggcaaccagtttttcgtcggctttaaagcccgccgggcagcccggcagctgaccgagttcgtaaccaaaggcagtgacatcggcatcgtggtaacgcgcttcgtcggaaaccacgatatcgcccactttcagcgttggcgcgagaccgcctgccgagccggtattgatgatcacatcaggtttgcagtgctccagcagcagcgtagcgcccatcgccgccgcgactttgccaatacccgatttcagcagggcgacttcagtgccattgagcgtaccggtgtaaatttcgcagcccgcgatattctgcgtctgacgattttcgattttgtcacgcagcagcgtcacttcttcttccattgcaccaataatgccaactttcatagagatactcgctaatgtgataagactgagttacgttttcagggcatagtctatcatggcaggcaggaatgcattacttcacatgacgcacgatcgcgggagaagaaatggctgagatcgattttcgcagaaaaataaactggcatcgccgctaccgctcaccgcagggcgtcaaaacggaacatgagatcctgcgcatctttgaaagcgatcgcgggcgcattgtaaattccccggcgatccgccgtctgcaacagaaaactcaggtcttcccgctggagcgcaatgccgccgtacgcacccggcttacgcactcgctggaagtacagcaggtggggcgttacatcgccaaagagatcttaagccgcctcaaagagcagcggctactggaaacctacggtctggccgaactgaccgggccgtttgaaagtatcgttgaaatggcctgtctgatgcatgacatcggcaacccgccgttcggccattttggcgaagcggcgatcaacgactggtttcgccagcgcctgttcccggaagatgccgccagccagccgctgagcagcgatcgctgtcaggtgaccgcgctgcgcctgcgggaaggggaggatgaactgaacggcctgcggcgaaaggtgcgccaggatttgtgtcattttgaaggtaatgcgcaggggatccggctggtacattcgctgatgcgtatgaacctcacctgggcgcaggtgggctgtattttaaaatatacccgtccggcgtggtgggtgggcgagccgcccgccagtcataattatttaatgaagaagcccggctattatttttccgaggaagcttacgtcgaccgcttacgtaaagagctggaactggatacgttcagccgtttcccgctcacctgggtaatggaagccgcggatgatatttcttattgcgtcgccgatctggaagacgccgtcgagaaaagaatatttaccgtcgagcagctttatcagcatctttatgatgcctggggcagccatgaaaaaggatcgctgtttgcacaggtcgtcgaaaatgcctgggataaatcccgcgccaaccgattaagccgcagcgccgaagatcagttctttatgtatttgcgggtcaacacgcttaataagctggtgccttacgcggcgcagcgctttattgataatctgccgcagattttctccggagaatttaatcatgcgctgctggaagacgaaagcggctacagccaattgcttgaattatataagagcgtcgcggttgaaaatgtcttcagccaccccgatgtagaacagctggaattgcaggggtaccgggtgatcagcggtttgctcgatatctatcggccgctgttgcaattaacgctcagcgattttagcgagctggcggaaaaagaacggctgcggcgtttcccgattgaaacccgcctttttcataagctctcaacccgtcaccggctggcgtatgtagaggcggtcagtaaattagatcgcgcggcgacagatttccctgtactggagttttattaccgttgtcgcctgatccaggactatatcagcggcatgacagatctgtacgcctgggatgaataccgccgtttaatggccgttgaataatagcgcagcaattgtaaagactgacaataaatttttacttttgcagaaagtccgttttggaacttcgcgctataaaatgactctcactgaaacaacacagcccttttgcgtaatcagtaatcagagattaaacaacatgaaaaaaacgacgttagccatgagtgcactggcattaagtttaggtttagcgctttctccgatgtcagctatggcggctgaaaccgcgtcctccgcgcaggccgctcagccgatgccgagtctggcgccgatgctggaaaaagtcatgccatcggtggtgagcatcaatgtggaaggcagcacgacggtgaacacgccgcgtatgggccgtaacttccagcagttctttggtgacgattcgccgttctgccaggaagggtcgccgttccagagttcgccgttctgccagggcggcgcgccgggcggatctgacggcggtcagcaacaaaaattcatggcgctgggttccggcgtaatcattgatgccgcaaaaggctatgtcgtcaccaataaccacgtggtggataacgccaccaccattaaagtgcagctgggcgacgggcgtaaattcgacgcgaaagttgtgggtaaagatccgcgctctgatctggcgctgatccagatccagagcccgaaaaacctgacggctatcaaacttgctgactccgacgcgctacgcgtgggtgactataccgtggcgatcggtaacccctttggcctgggcgaaaccgtgacctcggggatcgtttctgcgctgggacgtagcggcctgaacgcggaaaactatgaaaactttatccagacggatgcggccattaaccgcggtaactccggtggcgcgctggtgaacctgaacggcgagctgatcggtatcaacaccgcgatcctcgcgccggacggcggtaacatcggtatcggcttcgctatcccgagcaatatggtaaaaaacctgaccgcgcagatggtgcagtacggccaggtgcgtcgtggtgaactgggtattctgggaacagaactcaactctgagctggcgaaagcgatgaaagtcgacgctcagcgcggggccttcgtcagccaggtgatgccgaactcttccgccgcgaaagcgggcattaaagcgggcgatgtgatcaccaccctgaacggcaaggcgatcagcagctttgcggcgctgcgcgcggaagtcggctcaatgccaatcggcagcaaagtctcccttggcctgctgcgtgacggtaagccggtgaccgtcaatctggaactgcaacagagcagccagaaccaggtggaatccagcaccgtcttcagcggtattgaaggcgcggaaatgagcaacaaaggccaggatcagggcgtcaccatcagcaatgtgaaagccaattctccggcggcccgcattggcctgaaaaaaggcgatgtgatcattggcgcgaaccagcagcgtgtgaaaaatatcgctgagctgcgtaagatcctcgacagcaaaccgtcggtactggcgctgaatattcagcgtggcgacacctcgctgtatctgctgatgcagtaatccgccactcccttctccgccacggagaagggagttatccctccgttctgtgaagctttccacaactctacatttctgatccctgctctgtgcatttgcacaatgcgcgccgctattatcttttctattctggagcactgcttacgggagggatacatggctggctggcatcttgataccaaaatggcgcaggacatcgtgtcacgcacgatgtgcattatcgataccaatatcaacgtgatggatgcgcgtggccggatcatcggcagtggcgatcgggagcgtattggggaattgcacgaaggcgcgttgctggtgctgtctcagggtcgggtggtggatattgatgacgccgtggcgcgtcatctgcacggtgtgcgtcagggcattaaccttccgctgcgtctggaaggggagatcgtcggcgttatcggccttaccggtgaaccggagacgctgcgcaaatacggcgaactggtgtgcatgaccgccgaaatgatgcttgagcagtcccggttgatgcatctgttagcccaggacagccgcctgcgcgaagagctggtcatgaacctgatccaggcagaagagcacaccccggcgctgaccgaatgggcgcagcgtctgggcatcgatttaaatcagccgcgcgtggtcgcggtggtggaagtggacagcggccagctcggcgttgacagcgcgatggcggaacttcagcagttgcaaaatgccctgaccacgccggagcggaataacctgatcgccattgtgtcgctgacggagatggtggtgctgaaaccggcactcaatcagtttggccgctgggatgcggaagatcaccgcaagcgggtggaactgctgatttcgcgcatgaaagagaacgggcagttgcgctttcgcgtggcgctcggcaactattttaccgggccgggcagcatcgcccggtcatatcgtaccgcgcgtaccaccatgatggtgggtaaacagcggatgccggaaaaccgcagctatttttatcaggatttaatgctgccggtgctgctcgacagtctgcgcggcggctggcaggcaaatgaactctcccgtccgctggcgcgtctgaaagcgatggataacaacgggctgctcaggcgtacgctgacggcctggttccgccataacgtgcagccgctggcgacgtccaaagcgctgtttatccaccgtaatacgctggaataccggctcaaccgcatctcggaattaacaggtttagatttggggaattttgacgaccggctgctgctgtatgtggcgttgcagctggatgaacagcgttagataaaatatgccgggtggcggcttgcgccttacccggcctgtaaattcgcatcgttgcaggcccggtaagcgtgcgccaccgggcacgcgacggttatttattgcgggtcagcttttccagatcggcttcaatttcactgatcttattggtcacgaccgattccagatgacgaagatcgtctaagatcttacgcttcaggtcgacttccgtacgatcgcgctggcagatctgatccagctcatcgatcacgtaacgcaggttagggctgatttcctgcacttctttgtagccctgacccacgccatccgcgacaatggttttacgctggcgcgggtatttaaacttcacgcttttcgcgaaaaactcgcctttgtccttatgaaaatagattttcagaatatcgttattggcttcctgacggaggctgtagcgatcgatttcatccggattggtaatgcctaaacttttcagattatcgtacatagcggtacccttaagctcaacataacctatgaataattaacgaaaaaatctatcttcgccactgcgtcgtgcaaaaaaggcggggtgagtcaccctctccctgagggggagaggagataccttagtcgatcgtgcgcagcaattcgttaatgcctacttttccgcgtgttttcgcatctacttttttcacaatcaccgcgcagtacaggctgtaagagccgtctttagacggcaggttgccggagacaacaaccgagcctgccggcacgcggccataatgcacttcgccggtttcgcgatcgtaaatacgggtgctctgaccgatgtacacgcccatcgagatcacggaaccttcttccacgataacgccttccaccacttcagaacgtgcgccaatgaagcagttatcttcaatgatagtcgggttcgcctgcagtggctcaagaacaccaccaatacccacaccgccggagaggtgaacgttcttgccaatctgcgcgcaggaacccaccgtggcccaggtatccaccatggtgccttcatcgacgtacgcgccgatgttgacataggacggcatcagcacggtgttacgggcgatataggcaccctgacgcacggccgctggcggcaccacgcggaagccttctttctggaagcgcgcttcgtcgtagtcggcgaatttcatcggcactttgtcgaagtagcggctttcagcgccctcgatcactttgttatcgttaatgcggaaagagagcagcaccgctttcttcagccactggtgcgtcacccactgaccgtcaattttttctgcgacacgcagcgcgccggaatccagcagggcaataacctgattaaccgcttcacgggtaacggtatccacatttgccggggtgatgtcggcacggcgctcgaaagcggtctcaataacgttctgtaattgctgcatgtttactctttccatctgtataaaaaaaatcgttaccctttatcgtttggattgagggccgctgtcaaccgttgttgcacttcctgctggagcacattattaaggccacgccggtccgctgtggcgattataaataaatcttctactcgctcgccaattgtcgaaattctcgccccatgtaaggaaattccgaggtctgcaaacacctggccgacgcgggccagcagcccaggctgatcgagggcgatcagttcgaggaaggattttctgtccgtgtgggtcggcaggaaattgacctcggtgtcgacggtaaaatggcgcagttttgcgggctgtcggcgaggctgcggcggctgccagctgttctgggtgatcgcctgcagcagaccaaagcgaatgacctcatggcgatcagctgccagcggtttgccgtccggctccagcacgatgaaggtgtccatcgccatgccgtcgcgggtggtgaagatttgcgcgtcatgcacgctcaggttgcggcgatccagctcggcgcagaccgcggcaaacaggtaggggcgatcggggctccagataaagatttccgtgccgccgcgtgtggcctgcgggctgagcaggatcatcggctcgctcagatcgtgctgcaacagattacgcgcgtgccatgccagctgatttgggctgtggcgcacgaaatagttcgcccggcagcgcgcccagatatgatgcagcgcttcttcattaatgttgtccatgcgcaacagcgccagcgcctggatctgatgatgacgcacacgctcgcgcatatccggggtgttttgcattccgcgacgcagctgtttttccgtggcgaagtacagctcgcgcaacaggctctgcttccagctgttccacagggtttcattggtggcgcaaatgtccgccaccgtcaggcagaccaggaagcgcaggcggttttcggtctgtacttcttcggcgaactgcttaatgacttcgggatcctgaatatcacggcgctgggcagtcacggacatcaataaatgctggcgcaccagccaggcgaccagctgcgtttcccgtgagttcaggccatgcagttcggcgaatttcagcacgtcctgcgcgcccagcactgagtgatcgccgccgcgacctttggcgatatcgtggaacagagcggcaatgaggatcagctccggatgcgacaggcgcggccacagctccacgcacagcggatgcttctggcgcgtagcctcatcagcaaagctttccagcttcagcaggacgcggatggtgtgctcatccaccgtataggcatgaaacagatcgaactgcatctggccgacaatgtgcgaccactggggcatataggcccacagcacgctgtggcggtgcatcggcagcaggccacggctgaccgcgccggggtgacgcagcatgctgagaaacagcgtacgcgcttccgggataaaacagagcggctgcgtcagatgacgacgggcatggcgcaaatggcgcagggtggtggagtaaatgccggtgatgctgctgttgcgcaccatcatatagaacatgcgcagaatggcctgcggctcgcggataaacagcgtctcgtcccgcagatcgattagggtgccgcgcagttgaaactcatcgtcaatggcgcgcggtttttcatcggccgtcagcgcaagaatagcttcgtcaaacagttgcagcagcatctgattcagctcggtgacgcgacgggtcacgcgatagaagtctttcatcatatgctcgaccggctggttgccgtcgccggaatagttcaggcgctgggcgacgctcaactggcggtcaaacagcagacggttatcgtagcggttaagctccagatgcagcgcaaaacggatgcgccacagcagatgctgacattcgttcagttcgttacgttcggcctgagtcagaaagccgaagccaaccatctcgtttaaggaggtggcgccaaaatgacggcgggcgatccattgtaaggtgtggatgtcgcgcaggccgccggggctgtttttgatgtccggctcaaggttgtaactggtgccgtggtagcgttgatggcgctcgttttgctcttcaactttggcggcgaagaatttttccgacggccagaaaccgtcgctgaaaatgtgcttttgcagctccaggaacagcgcgacgtcgccaatcaacagccgggattcaatcagattggtggcgaccgtcagatccgataagccctccagcaggcactcttccagcgtgcgcacgctgtgcccgacttccagcttaatgtcccacagcagggtgagcagctcgccaatcttttgcgactgctcctctgagagctttttacggctgaggatcagcagatcgatatctgacagcggatgcagttcgccgcgtccgtaaccgcccaccgccaccagcgcggtgtcggcgacctcgccaaacccgtactccatccacaggcgctgtaacagctgatcgataaactcggtacgggcctcaatcagttgttcggcagaaagcccggcatcaaagacctcgcccagccagtgctggaaggcgtccagccgcgctttgatcccggcgcacgtcagctctcccgcaggccaggcgttagggttttccggctgaccgggcagggaaggggccgtgtgactgaactgctcgcagaggttatgactcatatcgcgcccatttataagaaaaaactatcgccataaaaaaagccggcaatcgccggcttcttcatcattcgttgtgcgagagtatcgccgggatggtgtcatcctttcgtaacgtcagaatttcgcagccgttatccgtcaccacaatagtatgctcgtattgagcagacaagctgcgatctttggttttcaccgtccagccgtctttcatggtgcgaatgcggtaatcgcccgcgttgaccataggctcaacggtaaaggtcataccggcctgcaacaccacgccgccgtcatccgcatcatagtgcagcacctgcggctcttcgtggaagccacgaccgatgccgtgtccgcaatattcgcgcaccacagagaagccttccgcttcgacaaatttctgaatggcggcgcccaggctgcgcagacgaatgcccggcttcaccaggcgcagggccagatagaggctctcctgggtgatgcggcataagcgctcgcccagaatggtcggtttgccgacgataaacatcctggaggtgtcgccgtggtaatcatctttgatcaccgtgacgtcgatattcacgatatcgccatctttcagcagtttttcgtcatccggaatgccatggcacaccacttcattaatagagatgcagacagacttcgggaaaccgtgatagccgaggcaggcagaaaccgccttttgctcattgacgatataatcgttacaaatacgatccagctcgccggtgctgacgccaggtttaacgaaaggctcgatcatttccagcacgtcggcagccagacggcccgccacgcgcattttttcgatttcttccgcagtcttaatagagatagccattgattctgtccatcggggtcgatcgggtcgaccataattgtgtaagtggcgtcaatggtatcagcctggcgcgccgcctgccagattgggaatgattaagcgcatccgtcgccaacaactgttggtgtcacgggcgtatttatggtataaagcgcgccggacttccgttccattttggcacgtgaagccacaaatctcactttgtgtaaataacacacacgtatcggcacatattccggggtgcccttcggggtcggtaatatgggatacgtggaggcataaccccaacttttatatagaggttttaatcatggcaactgtttccatgcgcgacatgctcaaggctggtgttcactttggtcaccagacccgttactggaacccgaaaatgaagcctttcatcttcggcgcacgtaacaaagttcacatcatcaaccttgagaaaactgtaccgatgttcaatgaagccctggctgaactgagcaagatctcttctcgtaaaggtaaaatccttttcgttggtactaaacgcgctgcaagcgaagcggtgaaagaagctgctaacagctgcgaccagttcttcgtgaaccatcgctggctgggcggtatgctgactaactggaaaaccgttcgtcagtccatcaaacgtctgaaagacctggaaactcagtctcaggacggtactttcgaaaagctgaccaagaaagaagcgctgatgcgtactcgtgagcttgagaaactggaaaacagcctgggcggtatcaaagacatgggcggcctgccggacgcactgtttgtaatcgatgctgaccacgaacacattgcaatcaaagaagcaaacaacctgggcatcccggtgttttctatcgttgataccaactccgatccggacggcgttgacttcgttatcccgggtaacgacgatgcaatccgtgctgtaaccctgtacctgagcgctgttgctgcaaccgtacgtgaaggccgttctcaggatctggctgcgcaggcggaagaaagcttcgtagaagctgaataataaggcacgctccccggagcccttattaaccaggtagtatcgagtttggttaaggggcctttttatggcccctttttcacttttaagctgtttggtcatcacgaccaggcagatcaaatctcccgaggattttagaatggctgaaattaccgcatccctggtaaaagaactgcgcgaacgtactggcgcaggcatgatggactgtaaaaaagcgctgactgaagccaatggcgacatcgagctggccatcgaaaacatgcgtaaatctggcgcgatcaaagcggcgaaaaaagcaggcaacgtagctgctgacggcgtgatcaaaaccaaaatcgacggcaactacggtgtgattctggaagttaactgccagactgacttcgttgctaaagacggtggtttccaggcgttcgctgacaaagtgctggatgctgcagttgctggcaaaatcactgacgttgacgtgctgaaagcgcagttcgaagaagagcgcgttgcgctggtggcaaaaatcggtgagaacatcaacattcgccgcgttgccgccctcgaaggcgatgtgctgggcagctacctgcacggcgcgcgtatcggcgttctgattgccgctaccggtgctgacgaagagctggttaagcagctggcaatgcatgttgctgcaagcaagccggaattcgttaagccggaagacgtgtctgctgaagtggtagagaaagaataccaggtacagctggacatcgccatgcagtctggcaagccgaaagaaatcgcagagaaaatggttgaaggccgcatgaagaaattcaccggcgaagtttctctgaccggtcagccgttcgttatcgatccgagcaaaactgttgctcagctgctgaaagagcacaacgctgacgtgactaacttcatccgcttcgaagtgggcgaaggcatcgagaaagttgagactgactttgcagcagaagttgctgccatgtccaagcagtcttaatcactaaaaggagccgcctgagggcggcttctttttgtaccccgctttaaaaaatcagcaaaatacctatgttgtttgtgctggtttgcgacgtaatatgtcgcctgaaataacccctctcaatcgttgacagtctcaggaaagaatcatggctaccaatgcaaaacccgtctataaacgcattcttctcaagcttagtggcgaagcgttacagggctccgaaggcttcggtattgacgcaagcatccttgaccgcatggcacaggaaattaaagagctggttgaattaggcatccaggtcggtgtggtgattggtggtggtaatcttttccgtggcgcaggtctggcgaaagcgggtatgaatcgcgtagtgggcgaccacatgggcatgctggctaccgtgatgaatggcctggcgatgcgtgacgcgctccaccgcgcctatgtgaacgcccgcctgatgtctgctattccgttgaatggcgtgtgtgacaactacagctgggcagaggcgatcagcctgctgcgtaataaccgcgtggtgatcctctcagccggtaccggcaacccgttctttaccactgactccgcagcctgcctgcgtggtatcgaaatcgaagccgatgtggtgctgaaagccaccaaggttgacggcgtgttctctgccgatccgatgcaggatccgaccgctaccctgtacgatcagctgagctatgctgatgtgctggatcgtgaactcaaagtcatggatctggcggcctttactctggctcgcgaccataaactgccgatccgcgtgttcaacatgaacaagccgggcgcgctgcgccgcgtggtcatgggtgaaaaagaaggcactttaatcacggactaatttccgtgagcgctaaataaaggtaagatcccgctttatttaaaagcgatttttatcagacactgtgacagtgtgatgaatgaaacgaggctatacttagcgcacctttgggtgtggctatgtgtggcctgcctgagacaagttttcaaggatccgtaacgtgataaacgacatcagaaaagatgctgaagtacgcatggaaaaatgcgtggaagcattcaaaacccaaatcagcaaagtgcgcactggccgcgcgtccccgagcctgctggacgggatcgttgtggagtactacggtaccccgaccccgctgcgtcagctggccagcgtcacggttgaagattcccgtacgctgaaaatcaacgtgttcgatcgttccatgggcccggccgttgagaaagcgatcatggcatccgatctgggtctgaacccgaactctgccggtagcgacattcgtgttccgctgcctgcgctgacggaagaacgtcgtaaagatctgatcaaagtggtgcgtggcgaagcggaaggcgcgcgcgttgccgtacgtaacgtccgtcgtgacgcgaacgataaagtgaaagcgctgctgaaagacaaagccatcagcgaagatgacgatcgtcgttcacaggaagaagtgcagaaacagaccgacgcggcgattaaaaaaatcgatgcggcgctggcggataaagaagcggaactgatgcagttctgatcctgcgcacatgatgacaacgccgtacagaaatccacagggtttgctggcggcgttttgctttctatcctccaaaattacgccgggcgtctgatgaagcaattaaccctccttggctcaaccggatctattggttgcagcactcttgatgtggttcgccacaatcctgaaaccttcgcggtgacggcgctcgtggccggtaaaaacgtggcgcggatggtcgaacagtgcctcgaattctcaccgcgctatgcggtgatggatgatgacgcctgcgcccgtcagttgaaagacgcgctggcgcagcacggcagccgtaccgaggtgcttagcggtcagcaggcggcctgtgacatggccgcgctggatgaggttgatcaggtgatggcggccattgtcggggcggcagggcttctgccgacgctggcggctattcgtgccggtaaaaccgtgctgcttgccaataaagagtcgctggtgacctgcggacgactgtttatggaagccgtgaagcacagcggcgcgcagcttttgccggtggacagcgaacataacgctatttttcagagtttaccgcaacctttccagcacaacctggggtacgctgatctggagcagaacggcgtgatgtcgattctgcttaccgggtctggtggcccatttcgcgaaacgccgctgtctgaactggctgcaatgacgcccgatcaggcctgccgccatccgaactggtcaatgggacgtaagatctccgttgattcagccaccatgatgaacaagggtctggaatacattgaagcacgctggttatttaatgcctccgccgatcagatggaagtgctgatccacccgcagtcggtgatccactccatggtacgttatctggatggcagcgtgttagcgcagctgggcgagccggatatgcgcacgccgatagcccatacgatggcctggcctaatcgtgtggtctcaggcgcgaagccgctggatttcagtacgctgagtgcactgacgttctgcgcgcctgattacgatcgttatccttgcctgaagctggcaatggacgcgtttgagcaggggcaggcggcaaccacagcgctgaatgcggcaaacgaagtgacggtcgcggccttcctggactcggctattcgctttaccgacattgctgccctgaatctgtctgtgcttgagaagatggatttgcgcgaaccgcaaagtatcgatgatgtactggctgttgataaacttgcgcgtgatgttgcacaaaaacaagtgacgcaactcgcaagctggtgatattacagccactcgtggttgtgctatttgttagcgtattacttcagtgatatagtctgcgccacctgatcgtggggcttttgtcctttcaggtcaggtaagccgtggttttacacggcttttttatgtaaaggcttcagtattcctggctaccgctaaatccttttcagggactaataacgcgttatgttgtctgctaatcaaccattaagcgagaatttgccagcgcatggctgccgtcatgttgcgataattatggatggcaatggtcgctgggcgaaaagacaagggaaattacgggcttttggtcataaagccggagccaagtctgttcgtcgtgcggtttcgtttgctgcgaataacggcatcgatgcattgacgctgtacgcttttagtagtgaaaactggaaccggccagcgcaggaagtcagcgcgctgatggaactgttcgtgtgggcgctggatagcgaagtaaaaagcctgcaccgccataatgtgcgtctgcacgtcatcggcgacaccagtcgttttaacgcccgtttgcaggaacggatccgtaaagctgaggccctgacggcacagaatacggggctgacgctgaatattgcagcgaactatggcgggcgttgggatattattcagggagtacagcatttagctgctcaggtccaggaagggctgttgcgccccgaccagattgatgaagacgcgctgagtaagcaaatctgcatgcatgaactggctcccgtagatttagtaattaggacagggggagaacatcgcataagtaactttttgttgtggcaaattgcctatgccgaactttactttactgatgttctttggcctgatttcgatgaacaagactttgaaggtgcgctgcatgcctttgccaatcgagagcgtcgtttcggcggcaccgagcctggtggcgacgaagcctgatgggggtagcttttgctgaagtatcgcctgatttctgcttttgtattaatccccgtcgttatcgcggcgctgttcttactgccgccggtgggatttgctattgtcactatcgccgtgtgcatgcttgccgcatgggagtgggggcagtttagcggtttcacgtcccggaacgcgcgggtatggctggcggtattgtgcgggctgctgcttgcgggctggctgttactgatgccggaataccattacaacgtccgccaaccgctggttgaaggcgcgctgtgggcatccttaggctggtggattgccgcgctgctgctggtgctgttttatccggcgtcggccagcctgtggcgacattcaaaagcgctacgtctcgtgttcggtatcctcaccattgtgccgttcttctggggaatgctgacgctgcgcgcctggcactatgacgataaccactacagcggcgcgctgtggctgctgtatgtcatgatcctcgtatggggcgcagactccggggcatacatgtttggtaaactgttcggcaagcataaactggcgccgaaagtatcgccgggcaaaacctggcaggggtttattggcggtttatttacggccgcggtaatatcctggggctatggcgtgtgggcaaatctggacgttgcgccttccacgctgctggtgtgctcaattgtcgcagcgcttgcctctgtactcggtgatttaacggaaagtatgtttaagcgtgaagccggtatcaaagatagcggtaaccttattccaggacacggcggtatacttgatcgcatagatagcctgacagcggcggtgccggtgtttgcctgtctgttattgctggtattcaggacgatttaacggaagattatatgctgagtattctctggaatctggcggcgttcattgttgcgctgggcgtgctgatcacggtgcatgaatttggccatttctgggttgctcgtcgttgtggtgtgcgggtagagcgtttttccatcggttttggtaaagcgctctggcgtcgcaccgataagcagggtacggaattcgttatcgcgcttatccctcttggcggttacgttaaaatgctggatgagcgcgtagagccggtgatcccggaactgcgccataccgcatttaacaacaaaaccgtcgggcagcgtgctgccgtcattgctgcgggtcccgtagccaatttcctctttgctatcgtcgcttactggctggtgtttatcatcggcgtgcctggcgtgcgcccggtaatcggtgaaataacacccaactcaatcgccgccagcgcgcaaattacgcccggcacggaacttaaagcgattgatggtatcgaaacgcctgactgggatgctgtgcgtttgcagctggtgtccaaaatcggcgatgcgcagactacaatcagcgtggccccctttggtactgacagccgtcagaacaagacgctggatttacgcgactgggcgtttgagcctgaccgcgaagatccggtcgcctcgctcggcattcagccacgcggtccgcagattgaaccggtactggcgcaagtgcaggctgactccgctgcaagtaaagcaggtttgcaagcaggcgacaggatcgttaaagtcgatggtcagcagttaacgcagtggatgacctttgtcacccttgtccgggataatcccggcacgccgttagcactggatatcgaaagacagggcagccccttgtctttgacactgataccagatacaaaaccgggtagcggcaaggacgaagggtttgcaggcgtggtgcctaaaattatcccgctgcctgacgagtacaagacagtacgccagtacggaccattcagcgccatcgttgaagccacggataaaacctggcaattgatgaagctgacggtcagtatgctggggaaattgataaccggtgatgtcaaactgaacaacctcagtgggccgatttctatcgcccagggggctgggatgtcagcagaatttgggttgatttactatctgatgttcctcgctcttatcagcgtgaaccttgggatcatcaacctgttcccgcttcctgttctggacggggggcacctgctgtttttagcgattgaaaagctaaagggcggaccggtatccgagcgagttcaagactttagttaccgcattggctcgattttgctggtgttgttaatggggcttgcacttttcaatgatttctctcggttatgagagctagttaggaagaacgcataataacgatggcgatgaaaaagttgctcatagcgtcgctgctgtttagcagcgccaccgtatacggtgctgatggattcgtagtgaaggacattcatttcgaaggccttcagcgtgtcgccgttggtgcggccctcctcagtatgccagtccgtcagggcgatacggttaatgatgaagatatcagtaataccattcgtgcgttgtttgccactggcaacttcgaggacgtccgcgtcctgcgtgatggcgatacccttcttgtacaggtgaaagaacgtccgactatcgccagcatcactttctctgggaacaaatcagtgaaagatgacatgctgaaacagaaccttgaggcttctggcgtgcgtgttggcgaatccctggatcgcaccaccctttccgatatcgaaaaagggctggaggatttctactacagcgtcggtaagtacagcgccagcgtaaaagcggtcgtcacgccgctgccgcgtaaccgtgttgacctgaaactggtcttccaggaaggcgtctcggcgaagatccagcagatcaacattgttggtaaccacgccttcagcaccgaagagttgatctcaaccttccagctgcgtgatgaagtgccatggtggaacgtggtaggcgatcgtaaataccagaaacagaaactggcgggcgatctggaaaccctgcgcagctactatctggatcgtggctatgcccgtttcaacattgattcgacgcaggtcagcctgacgccggataaaaaaggcatctacattaccgtaaacgtcaccgaaggcgatcagtacaagctttccggcgtggaggtcagcggtaatctggcaggtcactctgccgagattgaaagcctgaccaaaattgagccgggcgagctgtataacggcaccaaagtgaccaaaatggaagacgatattaaaaagcttcttggtcgctatggttatgcttacccgcgcgtacagtcgcagcctgaaatcaacgacacggataaaaccgttaagctgcatgtcaacgttgatgccggtaaccgctactacgttcgtaaaattcgctttgaaggtaacgacacctcgaaggatgccgttctgcgtcgcgaaatgcgtcagatggaaggggcatggctgggcagcgatctggttgaccagggtaaagagcgtctgaaccgtctcggttacttcgaaacggtggataccgatacccagcgtattccgggcagcccggatcaggtggacgtcgtttataaagttaaagagcgtaacaccggtagcttcaacttcggtgtcggctacggtacggaaagcggcgttagcttccaggtcggcgtgcagcaggataactggttaggcaccggctattccgttggcatcaacggcacgaaaaacgattaccagacctactctgagttctcgatcaccaacccgtacttcaccgttgatggtgtgagtctgggcggtcgtatcttctataacgactttgaagcggatgacgctgacctctcctcgtataccaacaagagctatggcgttgacggtacactgggcttcccgatcaacgagtacaacacgttgcgtctgggcttaggttatgtgcataacgatttgtccaatatggaacctcaggtcgccatgtggcgttatcttgactccatcggccagagcgccagtacgcaggatgatgacaacggcttcgcggccgatgacttcacctttaactatggctggacctataacagactcgaccgcggctacttcccgacggaaggttcgcgcgtcaacctgaacggtaaagtcacggtgccaggctccgataacgagttctacaaagtcacgctggatactgcttcatacttcccgattgatgatgaccacaagtgggtcgttctgggtcgtaccaagtggggttacggcgatggcctgggcggcaaagagatgccgttctatgagaacttctatgccggtggctccagcagcgtacgtggcttccagtccaataacattggtccgaaagcggtgtactacggcggtaacggccaggataactgtgataacaacgtagcaggctctgtctgtaactctgatgatgctgtgggcggtaacgccatgggcgtcgccagcctggaattcatcacgccgacgccgttcatcagcgacaagtatgctaactcggttcgtacgtccttcttctgggatgcaggtactgtctgggatacgaactgggaagacaccgcgcagatgaaagcgattggtgtgcctgattacagtgacccgagcaatattcgtatgtctgccggtatcgcactacaatggatgtctccattggggccgttggtcttctcttacgcccagccgtttaagaagtacgatggcgacaaagcagagcagttccagtttaacatcggtaaaacctggtaactggtctttgcaaaggactgcaatagcagtgtagcgtgacacggtttcgccctgtcacgcaaagaatggtacctgcgggtacatttgggatggtaaggagtttacagtgaaaaagtggttattagcggcaggtctcggtttagcgatggcaacgtccgcgcaggcagcagacaaaattgcaatcgtgaacatgggcaacctgttccagcaggtggcacagacaactggcgtttccaaaacgctggaaaatgagttcaaaggccgtgccggtgaacttcagaaaatggaaaccgatctgcagtctaaaatgcagcgtttgcagcgtgatggttctaccatgaaatcatccgatcgcagcaagctggaaaaagacgtaatggcacagcgccagaccttctctcagaaagcacaagcttttgagcaggatcgtcagcgtcgttccaacgaagagcgcggcaaactggttaaccgtatccaggcggctgtgaagaaagtggctgacgaccagagcatcgatctggtggttgacgcaaataccgttgcttacaacagcagtgatgtgaaagacattaccgctgatgtgctgaaacaggttaaataagtaatgccttcaattcgactgtctgaattagcagggcagttggatgcagaattacacggtgatggcgatatcgtcatcaccggcgttgcgtccatgcagtctgctaaagcaggtcaaattactttcatggtaaatccaaaataccgtgaacacctggccgcctgccaggcgtctgccgttgtcatgacgcaggacgatctcccttacgccaaaagcgcagcgctggtagtgaagaatccctacctgacttacgcgcgtatggctcaaattcttgattccacgccgcagccggcacagaacattgcgcaaagcgcggtgattgatgcctcggcaacactgggtcaaaacctctctattggcgcgaacgccgttatcgaatctgatgtggtattaggcgataacgtagtgattggcgcgggttgcttcgtcgggaaaaagactaaaattggcgcaggctcgcgtttatgggccaacgttaccgtttaccatgagattgagatcggtgagaattgcctgatccagtccgggacggtgatcggcgcggacggttttggctatgctaacgatcgcggcaactgggttaagatcccgcagctcggccgggtgatcattggctctcgcgtagagatcggcgcctgtaccactatcgatcgtggggcgctggatgacaccattatcggtaatggcgtcattattgataatcagtgccagattgcacataacgttgtgattggcgacaataccgcagttgcgggtggcgtcatcatggcgggcagcctgaaaattggccgttactgtatgattggcggtgccagcgtgattaacggtcatatggaaatctgcgacaaagtcaccgtaacgggtatgggcatggtgatgcgtccgattactgaaccgggcgtatactcctccggtatcccgctgcaacccaacaaagtgtggcgcaaaacagcagcactggtgatgaacattgatgatatgagcaagcgtcttaaagccgttgagcgcaaggtcaatcaacaagactaataattcatccgttttacgcccaaacttcccggcctgacggcattagcttgccgcgggccgtgttattattgccattaagtatatttagacaggaagagtattttgactactgacactcatactctgcacattgaagagattttagagcttctgccgcaccgttacccgttcttgctggtcgatcgtgtgctggattttgaagaaggtcgttttctgcgcgcagtaaaaaatgtttcggttaacgagccatttttccaggggcatttccctggcaaacctattttcccgggcgtcctgatcctggaagccatggcgcaggccaccggtattctggcgtttaaaagcgttggtaaactggagccaggcgagctgtattactttgcgggcatcgatgaagcgcgctttaagcgcccggttgtccctggtgatcagatgatcatggaagtgacgttcgaaaaaacgcgtcgcggcctgacacgctttaaaggcgtggctacggttgacggcaaagttgtttgtgaagctactatgatgtgtgcacgtagccgggaggcctgatacgtgattgataaatccgcctttattcatcctaccgccattgtggaagacggtgccgtcatcggcgctaacgttcatattggaccgttttgtcttgttggaccccatgttgaaattggtgagggtaccgtactgaagtctcatgtcgtgattaatggccacactgttattggccgtgacaacgagatatatcagttcgccactatcggtgaagcaaaccaggatttgaaatacgctggtgagccgacccgtgtagaagtgggcgatcgtaaccgcattcgcgaaagcgtcaccattcaccgtggaaccgttcagggtggtggattgacgaaggtgggcagcgacaacttactgatggttaacgcgcacgttgcgcatgactgtaccgtcgggaatcgctgtattcttgctaacaatgcaacgcttgcgggccacgtttcggttgatgattttgcaatcatcggcggcatgacggctgtgcatcagttctgcattattggcgctcacgttatggtcggcggttgctccggtgtggcgcaggacgtcccgccgtatgtaattgcccagggtaaccacgccacgccgttcggtgtcaacatcgaagggctgaagcgccgtggttacagcaaagaggcgctgtttgctatccgtaacgcttacaaactgctgtaccgtagtggtaagacgctggaagaagcgaagccggaaatcgccgcactggcggaacagcatccggaagtgaaggcgttcaccgagttcttcgaacgctcaacccgtggtctgatccgttaatgtctggtcgtcctcttacgatagccctggtcgccggagaaacctccggcgatattcttggcgcaggtcttattaaagcgctgaaagcacgccaccctgacgcgcgttttgttggtgtcgcggggccgcgtatgcaggccgaaggttgtgaagcctggtacgagatggaagagctggcggtgatgggcatcgtggaggtgctgggccgtttgcgtcgtctgctgcatattcgcgccgatctcacccgccgttttaccgatctcaagcctgatgtgtttgtcggcattgatgcgccggacttcaacatcacgctggaaggcaatcttaaaaagcatgggatcaaaacgatccattacgtcagcccgtccgtctgggcctggcgccaaaaacgcgttttcaaaatcggcagatccaccaatctggtgctggcttttctgcctttcgaaaaagcgttttatgaccggtttaacgtgccgtgtcgctttatcggccataccatggcggacgcgatgccgctggatcccgataaaaacgcggcacgcgatacgctgggcattgctcacgatgtgcattgtctggcgcttttgcctggcagccgcggcgcggaagtggaaatgctcagcgcagatttcctgaaaaccgcacagattctgcgtagccactatccggatctggaagtggtggtgccgctggttaacgcgaaacgccgcgagcagtttgagcgtatcaaagcggatgtcgcgccggatttgcgcgtgcatctgctggatggcatgggtcgtgaggcgatggtcgccagcgatgccgcgcttctggcgtccggcaccgccgcgctggagtgcatgctggcgaaatgcccgatggtggtgggctatcgtatgaagccgttcaccttctggatcgccaaacgcctggtaaaaaccgactacgtgtcgctgccgaatctgctggccgggcgtgagctggtgaaagaattattacaggaagagtgccagccgcaggcgttagccgacgcgctgttgcccctgcttgccaatggcaaaaccagccatgccatgcatgagacattccgcgaactgcatcagcagatccgttgcaatgccgatgaacaagcagccgatgcggtgctggagttagcgcaatgatggaatttatctatccgcacacccgattagtggccggtgtggatgaagttggccgtggcccgctggtcggagccgtggttaccgcggcggtgatcctcgatccggcgcgcccgattgtgggtctgaatgactcgaaaaaattatcggaaaagcgccgtctggcgctgtttgatgaaatcaaagacaaggcgctgagctggagtctgggccgtgccgaaccgcatgaaattgacgagctgaatattctgcacgccaccatgctggcgatgcagcgtgccgtggccgggctgcatatcgccccggaatatgtcctgattgatggcaaccgctgtccggcgctgccgatgccctccatggcggtcgtcaaaggcgacagccgggtcgcagaaatcagcgcggcgtctattattgccaaagtgacgcgcgatgcggaaatggcggcgctggatctgacttttcctcaatatggctttgcccggcacaaagggtatccgacagccttccatctggagcggctggcgatgcacggtgcgacagagcatcaccggcgtagctttgcgcccgtaaaacgcgcactgggactggtgtcctgatccttgcagcacaataagtaaaccggaagctaaaatggctgaaccacgtttcgtacacctgcgggtgcacagcgactattccatgatcgatgggctggcaaagaccgggccgctggtgaaaaaggcggcctcgctgggcatgcctgcgctggcgatcaccgattttaccaacctctgcggtctggttaagttctacgggacgggccatggcgcggggctgaagcccattgtcggcgcagattttcatgtgcagagcgacatcatgggcgacgagctgacgcagatcaccgtgctggccgccaataacaacggctatcagaacctgacgctgctgatctcccgcgcttaccagcgtggctatggcgcgcaggggccgtggatcgatcgcgactggctggcggagctgggcgatggcctgatcctgctgtccggcgggcgcatgggcgacgtcggtcgtagcctgctgcgcggcaacagcgcgctggtcgatcagtgcgtctcgttctacgaaacgcacttcccggaccgtttcttcctcgaactgattcgcaccggccgcccggacgaagagaactatttacatgcggccgtcgaactggcgcaggcccgcggcctgccggtcgttgccactaacgacgtacgctttatcgataccggtgacttcgacgcgcacgaaatccgtgtggccatccacgacggctttaccctcgacgatcccaaacgcccgcgtaactattcgccgcagcagtacctgcgtaccgaagacgaaatggtggagctgtttgcggatctgccggaagctctgcaaaacagcgtcgaaattgccaaacgctgtaacgtcaccgtgcgcctcggcgaatacttcctgccgcagttcccgaccggtgacatgagcaccgaagatttcctgatcctgaaatcaaaagaggggctggaagagcgtctggaattcctcttcccggacccggcggtgcgcgcagagaaacgcccggaatatgacgagcgcctggacattgaactccaggtgatcaaccagatggggttccctggctacttcctcatcgtgatggaatttatccagtggtcgaaggataacggcgtaccggtagggccgggtcgcggctcgggcgcgggttcgctggtggcctatgcgctgaaaatcaccgacctcgatccgctggaattcgacctgctgttcgaacgcttccttaacccggagcgtgtgtccatgcctgacttcgacgttgacttctgcatggagaaacgcgatcaggtaattgaacacgtggccgatatgtatggccgcgacgcggtatcgcagattattacctttggtacgatggcggcgaaagcggtgatccgcgacgtgggccgcgtactggggcatccgtacggctttgtcgatcgtatctcaaaactcatcccgcccgatccggggatgacgctggcgaaagcctttgaagccgagccgcagctgccggaaatctacgaggctgacgaagaagtcaaagcgctgattgatatggcgcgtaagctggaaggcgtaacgcgtaacgccggtaaacatgcgggcggcgtggtgatcgcgccgacgaaaattaccgactttgcgccgctgtattgcgatgaatcaggccagcatccggtcacccagttcgacaagaacgacgtggaatatgccggtctggtgaagttcgacttccttggtttgcgaacgcttactatcatcgactgggcgctgaagatgatcaacccgcgccgggccaaacagggcctggagccgattgatattgcggcgatcccgcttgatgacaagaaaagctttgatatgctgcagcgctcggaaacgaccgccgtgttccagcttgaatcgcgcggcatgaaggatctgatcaagcgtctgcagccagactgcttcgaagatatgatcgcgctggtggccctgttccgtcctggcccccttcagtccggcatggtggataactttatcgaccgtaagcacgggcgcgaagagatctcctatccggatgtgcagtggcagcacgaatgcctgaaaccggtactggagccaacctacggcattatcctgtaccaggaacaggtgatgcagatcgcgcaggagctttccggctataccctggggggcgcggacatgctgcgtcgtgcgatgggtaagaaaaagcccgaagagatggccaagcagcgttctgtctttgaagagggcgcgagaaagaacggcatcgacggcgaactggcgattaaaattttcgatctggtggaaaaattcgctggctatggctttaacaaatcgcactccgccgcctacgcgctggtgtcttaccagacgctgtggctgaaagcgcactatccggctgagtttatggcggcggtgatgaccgccgatatggacaacactgagaaggtggtggggctggtggatgagtgctggcgcatggggcttaagatcctgccgccggacattaactccgggctgtatcatttccacgttaacgatgacggtgaaattgtctatggcatcggcgcgatcaaaggcgtgggtgaaggcccgattgaagccattctcgaagcgcgtaataaagacggctatttccgcgagctgtttgatttatgcgcccgtaccgacaccaaaaagcttaaccgccgggtgctggaaaaactgattatgtccggggctttcgaccgcctcggaccgcaccgtgcggcgctgatgaatgcgctgggcgatgcgctgaaagccgccgaccagcatgcgaaagccgaggctatcggccaggctgacatgtttggcgtgctggcagaagagccggagcaggtggagcagtcctatgccagctgccagccgtggccggaacaggtggtgctggatggcgagcgtgaaaccctgggtctgtatctgacagggcacccgatcactcagtacctgaaagaaattgagcggtatgtcggcggcaatcgcctgaaagacatgcacccgacggaacgtgggaaagtcaccacggcggcggggctcgtcattgctgcgcgggtaatggtcaccaagcgcggcaatcgtatcggcatctgtacgctggatgaccgttccggacgcctggaggtgatgttattcaccgacgcgctggataaatatcagcatttgctggaaaaagaccgcatacttatcgtcagcggacaggtcagctttgatgacttcagcggcgggcttaaaatgactgcccgcgaagtcatggacattgacgaagcccgggaaaaatatgctcgcgggcttgctatctcgctgacggacaggcaaattgatgaccagcttttaaaccgactccgtcagtctctggaaccccatcgttcggggaccattccagtacatctctactatcagagggcggatgcacgtgcgcggttgcgcttcggtgcaacgtggcgtgtctctccgagcgatcgtttactcaacgatctgcgtggccttattggttcggagcaggtggaactagagtttgactaatacaggaatactatgagtctgaatttccttgatttcgaacagccgattgctgagctggaagcgaaaatcgattccctgacggccgtaagccgccaggatgagaaactggatattaacatcgacgaagaagtgcatcgtctgcgtgaaaagagcgtagaactgacgcgcaaaatctttgccgatctcggcgcatggcaggtcgcgcaactggcgcgtcacccgcagcgtccgtacaccctggattatgtccgcctggcatttgatgaattcgacgagctggcaggtgaccgtgcttacgctgacgataaagccattgttggcgggatcgcgcgtctggatggccgtccggtgatgatcattggtcatcagaaggggcgcgaaaccaaagagaaaatccgtcgtaacttcggcatgcccgctccggaaggctatcgcaaagcgctgcgtctgatggaaatggcagagcgttttaacatgccgatcattacctttatcgacacccccggcgcttatccaggcgtcggcgcggaagagcgcggtcagtctgaagccatcgcccgcaacctgcgtgaaatgtcgcgtctgaacgtacctgtcatctgcaccgtcattggtgagggtggttccggcggcgcgctggcgatcggcgttggcgataaagttaatatgctgcagtacagcacctattccgttatctctccggaaggttgtgcgtccattctgtggaaaagcgccgacaaagcgccgctggccgcggatgccatgggcattatcgcgccgcgcctgaaagagctgaagctgatcgacagcgtgatcccggaaccgctgggcggcgcgcaccgtaacccggaagcgatggctgcctccctgaaagcgcaactgctggacgatctggcggatctcgatgtgctgagcaaagaagatctgcgtaaccgtcgttaccagcgtctgatgagctacggctacgcctgatacgcgtcatgattctgaaaagccacactatagtgtggctttttttatacctgccgtttacctcaactatcattagcggaggttttttgcaggagtgacgcgtgaatattattgccattatgggaacgcatggcgttttttataaagatgaacctataaacgaactggtcatcgcactggagaaacaagggtttaaaatcatcttcccgcagaacagcgccgatctgctgaagtttattgagcataacccgcgcatctgcggcgtgatttttgactgggacgagtacggcattgagctgtgcagcgatattaatcagctcaacgaatatctgccgctgtatgcttttatcaatacccactcaacgctcgacgtcagcgcccacgatatgcgcatggcgctgtggttctttgaatatgcgctggatgtcgctgacggcatcgccacccgcattgagcagtacacccgcgaatatcttgataacatcacgccgccttttacccgcgcgctctacacctatgtgaaagaggggaaatacaccttttgcacgccagggcatatggcgggaacggcgtatcaaaaaagtccggtgggctgcctgttttatgacttctttggcggtaatacgctgaaagcggatgtctcgatttccgtcactgagctgggctcgctgctcgatcataccggtccgcatctggaagcggaggagtacatcgcccgcacctttggcgccgagcagagttatatggtgaccaacggcacctcgacgtccaacaaaatcgtcggcatgtacgccgcgcccaccggcagcacgctgctgattgaccgcaactgccataaatctctcgcccatctgctgatgatgagcgatgtcgtgccgctgtggctgaagccggggcgtaacgcgctgggtattctgggcggcattccccgtcgtgaattcagccatgcaagcattgagcaaaaagtggcggccaccagcggggcggcctggccggtgcatgcggtgatcaccaactccacctatgacgggctgctgtacaacaccaactggatcaagcagaccctcgatgtaccctcgatccattttgattccgcctgggtgccttacactaatttccatcccatctatgccggaaagagcggcatgagcggtgaacgcgtgccggggaaagtcttcttcgaaacccagtcgacgcataaaatgctggcagcgttttcgcaggcctcgctgatccacattaaaggcgagtacgacgaggagacgtttaacgaagcctatatgatgcataccaccacctcgccgagctatccgctggtggcctctattgaaacggcggcggcaatgctgcgcggcaatcccggcaaacggctgatcaaccgttccgttgagcgggcgctgcatttccgtaaagaggtgcagcggctgaaggatgaggccgacggctggttctttgacatctggcagccggaggaaatcgacgaggctgactgctggccggtggcgccgggggagagctggcacggattccgcgacgcggacgccgatcatatgttcctcgatccggtcaaagtgaccattctcacgccgggcatggatgagcagggcaacatgagcgatgaagggatcccggcggcgctggtggcgaaattccttgatgagcgtggcgtggtggtggaaaaaaccgggccttacaatctgctgttcctgttcagtatcggcatcgacaaaacgcgggcgatgggactgctgcgcgggctgatggagttcaaacgcgcctacgatctgaatctccgggtgaaaaatatgctgccggatctctacgcggaagatcccgatttttatcgcaatatgcgtattcaggatctggcgcagggcattcatcaactgatccgccagcacgatctgccgcgcctgatgttacaggcctttgacgtgctgcccaccatgcgtatgaccccgcaccaggcctggcagcagcaggtgaaaggcgaggtggagacggtggcgctggagaagattgtcgatcgcgtgtcggccaatatgatcctgccttatccgccgggcgtgccgctgctgatgccgggggagatgatcacagccagaagccgcgccgtgctcgatttcctgcttatgctctgcgccattggccgtcattatcccggctttgaaaccgacattcacggggcgaagcgcgatgaagagggcatctaccgggtacgagtcctaaaacagggctgaccccttgcagagcgtcgcgggcgatcgtaacgtgcagggatcggaaaaaggagacagcatgctcggcttaaaacaggttcaccatatcgcgatcatcgcgagcgactatacccgcagtaagacattttactgcgacattctgggctttagcttacaaagtgaagcgtaccgtgcggagcgggactcctggaaaggcgatctggcgctgaacggtcagtatgtgatcgagctgttttcatttccgtttccgccggcgcgtccgagccatccggaagcctgcggtttacgccacctggcgttcagcgtggatgacgttgaagcagcgatcgcgcatctggaagcccataacgtgacctgcgagccggtacgtgtcgatccctttaccggcaaacgttttaccttctttaacgatcccgacggtctgccgctggaactttaccagcagtaacgcttgccactgtggaagatgcccggtaacgtgccgccatcttcctttttaaacgatcatcatgaccatttccgctcttgcacagtcccttgaaccgcatcgccagttgctggtggggttcagcggcggcctcgattcaaccgtactgctgcaccagctggtgtgctggcgcgaacagcagccggaggtatcactgcgcgcgatccacgtccatcacggtctgaacgcccgcgcggatgagtgggtggaacagtgccaggcgctttgcggacagtggcaggtaccgcttaccgtcgtgcgcgtgactttaaaccaggccggggaaagtattgaagcgcaggcgcggcaggcgcgctatcaggcttttcgcgaggcgctgttgcccggcgaagtgctgcttaccgcccagcatctggacgatcagagcgaaacttttctgctggcgttaaagcgcggcagcggcccggcaggactggcgtcgatgcccgcctctctgcctttcggcgatacgctgttgctgcgcccgctgctctgtacccgccggacggcgctggaagcctgggcgcagcagcacgcgctgcgctggatcgaagatgacagcaatcaggatgataaatacgaccgcaactttttacgtctgcatattttgccgcgtcttaacgcccgctggccgcattttgccgacgcggtggcgcgcagcgcagcactatgcggcgagcaggagcagctgcttgacgagctactggcggaagagctggccgcgctgaccaacgaagcgggtgcgctgcatatcaccccgctgatgacgaaaagcgccgtccgacgcgcagctatcctgcgccgctggctggcgcagcagggcgcggctatgccatcacgtgaccggctggcgcgcatctggcaggaagtggcgctggcgcgcgacgatgccacccccggcctgacgctgggcgatggagagatccgtcgctatcagggactgctctggtgggtaaaggtgccgcaaagtcagcgcgacacacaaatcggctgggatgatccctttcagccgctggccttacccgcgggcctgggagagttgcagcttataacaggcggcgagatacgtgccccgcgcgccggtgaacgggcgacagtgcgtttttacgcgcccggaatgctgcatatccttggtcgtgccggggggcgtaagctgaaaaaaatctggcaggagctgggagtgccgccctggcagcgggatagcacgccaattctgttctatgatgaaacgccgattgccgcggcggggcagtttataacgcgggacggactggcggagggggaagccggttttacgttgcggtggaaaagataacgggcagccaggctgcccgcttgattgactcaggactcgctcaccacaacggtgccgatttgcggatggctgaagctggctatcctgtcgaggcggagttcccgcgtcgtgccagcggcatcagcgaccaggtattcaacattcttacgcatgaccaaatcgctggcttttgcctgcaagacttcgccgtctttgagttccagcgtcagtaaaagatgatgctggcaggcgagctcgaggttgtcatagtcatcacaattgatgggttgataagtatcattcattgacataatcgctcaccagtaagttcgcggcagcataagccgccttttccctgacagactccgaagtcgcaccatctgatgccacttcattgagtacgtttaacacgcagcccagcgcatcggggatataccctaagtctccgctggcgatctccgcataccgcttgcgtattaactcacagtaattttccacatgtcctcctgtcagtgtgctgacttcaccatgggatgtaagtttaagcctacgaagataaactctgtttagcaaggtgactataccacactcattggcgcattatcagcgtagtaagcggtcactactttaagagtaaacagcgctttatcccttaattcgctacaatggggataattttgtgcaggagtggtgtcatggcgttaaaagcgacaatttataaagcgacggtcaatgtggccgatctggatcgtaatcagtttatggatgctacgctcacgctggcccgccatccttctgaaacccaggagcgcatgatgctgcgcctgctggcgtggatcaaatatgctgacgagcggttacagttctcccgtggcctgagcgccgaagatgagccggaagcctggcggcataacgatcacatgggcatcgacctgtggatcgagctgggcctgccggatgagaaacggatcaaaaaagcctgcacccaggccaaagaagtggcgttgtttacctataacagccgttctgcgcaaatctggtggcagcaaaatcagaccaggcttgcgacctacagcaacctgagcatctggtatctggatgatgaacagctggcgaagctcagcgattttgccgggcgtaccatgaccctgcaggccaccattcaggagggggcgatctggctgtctgatgcgcagaataacctggagatccatctgaccacctggcaacaaccggcatgatcacgctgtcatcgaatgtcactatcccggacaacgaactggagatcaccgcgatccgttctcagggcgcgggcgggcaaaacgtcaataaaacctccacggccattcacctgcgtttcgacattcgcgcctccagcctgccggagttctacaaagagcgcctgctggcggcgacgcaccatttgatcaccgcggaaggcgtggtgattattaaggcgcaggagtaccgcagtcaggagatgaaccgtgaagcggcgctggcgcggctggaagcgttgataagagaattaaccgtggtacagaaaagccgacgtccgacgcggcccacgcgcgcgtccaaagagcggcgtctggcgggcaaagcgcagaaatcgactgttaaatccctgcgcggcaaagttcgcccataaaaaaagcccggtcaggttaacgtgaccgggctgtcgtttgccgggtggcgactgcgtcttacccggcctgcatgagcttatgtaggcccggcaagcctgcgccgccgggcaataataatcctcagcctttaatcgccttgaccagatacggcaggatgtccccggttttgatcatctgcttctcgccgctacgacgatatttgtactcaatttcgtcgctgtcgaggttacggtcgccgataacgatagtgtgcggaatgccgatcagctccatgtctgcaaacatcacgcccggacgctctttacgatcatccatcagcacttcaatgccctgcgcacgcagctcgctgtagagcttctctgccagttcctgcacgcggaaagatttgtgcatattcatcggcagaatggcgacctggaaaggcgcaatggcatcaggccagacgataccgcgttcgtcgtggttctgctcgatggccgcagccaccacacgggtcacaccgataccgtagcaacccatggtcagcgtaacgttacgaccatcttcaccctgtacggaggctttcagcgcttcggagtacttggtacccagctggaaaatatgacccacttcgataccgcgtttgatcaacagcgtaccctgaccgtccgggctcggatcgccggccaccacgttacgcagatccgcgacttctggcgtcgccacatcgcgatcccagttgatgccaaagtagtgtttaccgtcgatgttcgcgcctgcggagaaatcactcatcgcggcaacggtacggtcgataactaccgggatcggcaggttaaccggacccagcgagccagggcctgctttaaccagcgcgcggatctcttcttcgctggcgaaggtcagcgggctggccacctgcggcagtttttcggctttgatttcgttcagttcgtgatcgccacgcaccagcagggcaaccagcggatatgcgctgtcttcgaccgcttttaccagcagggttttcacggttttctcgatgggcagattgaactgctcaaccagctcggcgatggttttcgcgttcggcgtatcaaccagcgtcatttcctgcgtcgcggcggcacgcggctctttcggggccagcgcttcggcaaattcaatgttggccgcgaaatcggagctgtcggagaatatcacatcgtcttcgccgctctgcgccagcacctggaattcgtgcgaagcgctaccgccgattgagccggtgtcagcctgtaccgcgcggaagtccagacccatacggctgaagattttgctgtaggccgcatacatggcgtcgtaggtttcctgcagggattcctgagaggtatggaaagagtaagcatctttcatcaggaattcacgggagcgcatcacgccgaaacgcgggcgcacttcgtcacggaatttagtctggatctggaagaagttcagcggcagctgtttataggagctgagctcgttacggatcaggtcggtgatcacttcttcatgcgtcgggccgagcacgaacggacgttcgccacgatcgacaaaacgcagcagttccgggccatactgctcccagcggccgctttccacccacagatcggcgggctgaacaaccggcatggacacctcgatcgcaccggcgttgttcatctcttcacgcacgatgttttcgacttttttcagcacgcgcaggccggtcggcagccaggtgtataacccggaggccagcttgcggatcatcccggcgcgcagcatcaactggtggctgatgacttcggcatcggcaggtgtctccttcagagtggagagcagatattggctagtacgcatgtagttacggttccatttggacgatgagcacaggctcaaaacgagcctgacacaaaaaaagtggtttagtttatcagcctggcaatgatgccaaaagagagcgcactaaaattagcgcgattccagcgcaaagacctcaaatcccgacggcgttacgcgccagcgtacgttaaagtccagcaaccatacggcataggttttgcccatctcttcttctttgcggtaggccgggcgcggatcctgggccagtacatcgatgatgaactgtcgcagggcagggtagcgctgctccagcgccgttaactgccgggcaatgtcttcggtaaaaaacaccggcatattcgcctgcggcgcaagctgggcatagctggctttcgcgtcgggtaaggcttcggcgaacggcagatagggcttgatgtcgatcactggcgtgccgtcgaccagatccagactgccgagctcaagaatgacctgatctttctggcagcgaatgccttttaattcaaccagcgacatgccgaccggattcgggcggaatgttgagcgcgtggcaaacacgcccattcgggcattgccgccgagacggggagggcgcaccgttggccgccagcccccttccatcgtctgatggaaaacaaacagcacccacagatggctgaacgcctcaaggccgcgtacagcatcggcctgattgtatggggcagtaagatgaagttcgccgcgactgtttaccagccctggctggcgcggtacggcaaacttctctttatagggcgaacggataacgcctatttgctcaaacgaaaaggcactcattttgccgtaatgttaagcgcagtaccgatgcatactgcctgacgatagcagcccggcgtgccgctggtaacttcacagctgtgctgtaacacggcgttggcgcgcaatttagaagcgttaatctgcatgcgtttacgtgcggtagggatattcggcggggagtcctgattagacgcctggcaggagtcgccggacacttcacccagatcgcggaacggtttaccaaccagctcttcggcattggtgataattcttaccggggccgcgcgcggcgcttttggtttttccggctcggtttttgtggttgtagcggtgcccctggccggttcgacgggagatctgcttagcatggaacagccgctcagcatgagtgccagtaaacagatcggtaaagcgcgcataatatatcctcagtaaataatggcattaccaggtattgaaacaggagagtacagaaatgacaaggcgggcttacgcccgccttgaaggatattacagaaaaaagcgattaccagcctttaaccgcgccgccgttaaagactttgttggcttcctggtaaacttcatcagactggtaagcctggatgaatttcttcacgttttccgcatctttgttgtcttcgcgggatacgagcaggttgacgtacggggagtctttatcttcaacgaagataccgtctttcgccggcgtcaggttgatctggctggcgtaagtggtgttgatgacggccagcgcaatctgcgcgtcgtctaacgagcgcggtaactgcggcgcttccagttcaacaatcttcaggtttttcgggttttccaccacgtccagcacggtcggcagcagaccgacgccatctttcagtttgatcagaccctgtttttgcagcagcagcagggaacggcccaggttagtcggatcgttcggaacggcaacctgcgcgccttcctgcaactcatcaatggatttgatttttttggagtagccggcgatcgggtaaacgaaggtgttcgccacggaggtcagcttatagccgcgatctttgatctgctgatccagataaggtttgtgctggaaggcgttcaggtcgatatcgcctttgctcagcgcttcgttcggcagcacgtaatcgttaaaggtcaccagttccacgtccagaccgtatttctctttcgccactttcgcggcggtttccgctacctgctgctcagcgccgacgatcacgcccactttaatgtggttgggatctttttcgtcctgaccgcaacccacgagggccagagaaccaatcagggcacccactgccgcaaaggtcttgaatttaaacgccatgctatttccttaactctcagagtcgattgtgttgtttataacgttatttgtgagtgacagcccggacgatacgatcgcccgagaactggatcagataaaccagcaccaccagcagtaccagcaccgtattcatcacggtggcgttatagccgatgtaaccgtactgatagccaatttgtcccaggccaccggcacccacagcaccgcccatggcggaataacccacaagggtgatcagggtaatggtagccgcgttcaccagaccagcaagggcttccggcagcaggaccttacgaatgatctgcatcggcgtggcacccatcgcgcgtgaggcttcgataagtccggtcgggatctccagtaaggcgttctcaaccatacgggcaataaagggcgctgcgcccacggtcagcggtacgatagccgcctgcaagccgatggaggtgcccacaatcacgcgcgtgaaggggatcatccagaccagcaaaataatgaacggaatggagcggaaaatattcaccagcgcggaaatgctgcgatacagctttgcgttctcgctgatctgaccgggacgggtgacgtacagcagtacgcctaccggcagcccgatcacaaaaccaaagaagccggagacaaaggtcatcgccagcgtctcccagacgccccgcgccagtaaccacatcattggctcagacataacccagcacctctacttttacatggtgttcctgcagccacgcaatggcggcttgcgtatcctgttgtgtgccgtgcatttccgtcagcatgatgccgaacttcacgccaccggcgtaatccatctgcgcgctgataatgttgttgttcacattaaaacggcgtgcggtttcagaaagcaggggagcatccaccgactgaccggtaaattccatacgcagcatcggcacgctggtggcgcccggctctgccgtcatgcgctgctgataatcttccggaatgtccagatgcagcgtggactgaataaactgttgcgccagcggcgttttcggatgcgagaacacttcgctgacggtgtcctgctcgataagctcgccgttgctgatcacggccacgcagtcgcagatacgtttcaccacgtccatttcatgcgtaataaggaggatggttaaaccaagacggcggttaatatctttgagcagttcgaggatggagcgggtcgttgctggatccagcgcgctggtggcctcatcacacaacaatactttgggattgctggccagcgcacgggcaatggccacgcgttgtttttgaccgccggaaagattcgccggatagctgtcatgcttatcgctcaggcccactaactccagcagctcggtgacgcggcgtttgatttcagcggcgggggtgttgtccagctccagcggtaatgcgacgttgcccgccacggtgcgcgaagcaagcaggttaaaatgctggaagatcatgccgatctgacgacgggctttggttaactgggattcggtcagggcagttaaatcctgaccgtcaaccagcacgctgccctgcgtcggacgctccagcaggtttacgcagcggattaaggtacttttccccgcacctgaagcgccaatgacgccataaatttgaccggcagggacatgcaggctgacattgttcagcgcctgtatggtgcggttcccctgctggaagactttggtgatattcgaaagtttaatcattagattatttttatcgtttaaaagttagccgtggcattttgttctgccggatacgggcgatgaccgtaaacaaaacggatgttaaggcatccagacgtctatttcaatgtaactctgtatgatgagcactttcttgcgttcagaaacatgagatactagcgccataggtcttatataaaggagcaaaccggtggcacagtcagtacccgcaatttttctcgatcgtgatggcacgattaatgtcgatcatggttatgtccatgagagtgataacttcgaatttatcgatggcgtaatagatgccatgcgtgaattgaaagcaatgggctatgcgctggttgtcgtcaccaatcagtccggcatcgctcgcggtaagttcagcgaagcgcagttcgaaacgctgaccgaatggatggactggtcgctggcggatcgcggcgtcgacctggatggcatctattactgcccgcatcatccggaaggaagcgtggaagagttccgccaggtttgtgattgccgtaaaccgcagccgggaatgcttatctcagcgcgcgactttttgcacattgatatggcggcttcttatatggttggcgacaaactggaagatatgcaggctgccgctgccgcaggtgtgggtcataaagtattagtgcgcacgggtaaacccgtcacgcctgaagcagaaaacgcagcagattgggtgataaatagccttgctgacctgcctgcggcaatcaaaaagcagtaaaaataagcgttatgatgaaaaggtgagcggttgaaacaaaaatgcagttttatgcttgtcatcccgtccggactccctataatgcgcctccatcgacacggcggatgtgaatcacttcacacaaacagccggttcggttgaagagaaaaaatcctgaaattgagggttgactctgaaagaggaaagcgtaatatacgccacctcgcgacagagcgctaaagcgcgtcgcaactgctctttaacaatttatcagacaatctgtgtgggcactcaaggacatggattcttaaacgtcttcggacgctaaatgaataccaagtctctggagtgaacatacgtaattcattacgaagtttaattcacgagcatcaaacttaaattgaagagtttgatcatggctcagattgaacgctggcggcaggccta

SEQ ID NO: 4 - DNA, 421441 bp, Enterobacter sp SA187
tagcgtctttcgacgtttaagaatccatgtccttgagtgcccacacagattgtctgataaattgttaaagagcagttgcgacgcgctttggcgctgtgtcgcgaggtcccgtataatacgttttcctcattcagagtcaagcgattattttgcttttctctgccggtcattcccggaggaagaccttctgacccggtggcctgtaagccgttgttccgtgtcagtggaggcgcattatagggagttattccgggctgacaacccctaatttcaaaaaacttttcaagcgcgttttttttcatcaaagcgttgtaaaaagcatcatcatttggcgaatttgctctttttatcatcgacatcccccggcagatggcatactagaacgtaaaaatgagaaaaaggaatgcgacgaatgcctttaagcgcacaacagttagcggcacaaaagaacctttcttatgtactggctgaaaaactggcccaacggatcttaaccggtgagtatgcgcccggaagcatcctgcctgcagagatggaattaggcgaagcgttcggcgtgagccgtaccgccgtaagagaagcagtaaagaccctgactgcaaaaggcatggtgctgccgcgtcctcgcataggtacacgcgtgatgccgaaaagcagctggaacttccttgataaagaactgctctcctggtggatgaccgaagagaactttcaggaagtcattcagcacttcctggttctgcgcagcacccttgaacctcaggcatgccagctcgcagcccttcttggcagcgcagagcaaaaagcgcatttgaatacgctgatggatgagatggtgcaattaaagaagcatttccagcgcgagcgctggatagaagtggatatggcctggcatgaacatatctacgcgatgagcggcaatcccttcctcacctctttcgctgccctctttcattcggtgtaccacacctacttcacctctattacacaaaatgaagtggtaaagctcgaaaatcatcaggcgattgtggatgccattcaggaaagcgacgctcagggtgcctatgaggcctgccagctattgttgaacgctccccacccggctaaataacaggaattcgcatgacagagaaaaaagcgcgcagtatggcgggcctgccgtggatcgcggcaatggctttctttatgcaggcgctggatgcgaccattttgaacacggcactgccggcgatagcccagagcctgaaccgttccccattggcgatgcagtcggcgattatcagttacaccctgacggtcgctatgctgatcccggcgagcggctggctggcggaccgcttcggcacacgccgtgtctttatgctggccgtttcgctgttcaccctcggttcgctggcctgcgcgctgtcgagttcactcggtatgctggtcatcttccgggtagtgcaggggatcggaggcgcaatgatgatgccggtggcgcgtctggcgctgctgcgtgcatatccgcgcagtgaactgctgccggtgctgaacttcgtgaccatgcctggtctgataggcccgatcctcggcccggtactgggcggcgtgatggtgacctgggcgagctggcactggatattcctgatcaacattcccatcggtatcgccgggctgttttatgcccgtaaatatatgccgaacttcacgacgccacgccggggcttcgatatgcggggcttttttctgttcggcctgagcctggtgctgttttcctgcggcatggagctgtttggcgagaagattgtcgccagctggatcgccctgtcggtgatcgtcaccggccttttacttctgctggcttatatccgtcacgcccgccgacacccgacgccgctgattgcgctgccgatgtttaagacgcgtaccttttccgtcggcatcgccggtaatctggcgtcccgccttggaaccggatgcgtgccctttttaatgccgctgatgttacaggtcggctttggctatccggcgctgatcgcgggctgcattatggcccccaccgccatgggttctattctggcgaaatccgcggtgactcaggttctgcgccgctttggttatcgtaatacgctggttggcattacagtgattatcggcgtgatgatcgcccagttcgcgctgcaatccccctccatgccgctgtggatgctgatcctgccgctgtttgtgctggggatggcgatgtccacgcagtttaccgccatgaataccattacccttgccgatctgaatgatgagaacgccagcagcggtaacagcatgctggccgtgacgcagcagttatccatcagtctgggggtggcggtcagcgcggcggtgctgcgcttttatgaagggtttgagaacgcgaataccgtggagcagtttcactacacctttattaccatgggggtagtcacgctgatatccgcttccgtctttatgctgttaaaagccaaagacggtcgtaacctgattaaagagcggcacaaagcttaggcggagccgcgttccattaacaccggcgtcagttgcagacgctgctggaccagggtgggatcggtgatgcgatgcagtaacacatcgatagccagctcacccagttcatctttcggctgatggatggtggtcagcgggggcgtcatgtaacgcgccagctcaatatcatcgtagccaacaatcgccatatcctgcggcaccttcagtccggcctgatataacgcctggtacgcgccaaaggccatggcgtcgttaccgataaacaccgcctgcggacgcgctttttgcgccagcaggatctgcattgcctcatagccgccgccaaactcaaagttaccgacgatctcatcgccttcacgaatttcgaggcctgcgcgtgccatggcttcgcgatacccctccagacgtaaacgcgccggggttttatccagcggcccggtaatgcaggcgatacgggtatggcctttatcaatcaggtgctgcgttgccatatcaccgcccagcagcgagttatcctgaatgagatcgctgtaaccatcgaacggcgcccagtccatcatcaccgtcggaatggacgggtagcgctgcatgatttcctgcgagggctgatgggtttcggtgcacagcaacagtaagccatcgacgcgcttttgcatcagcgtctccagattactgttcatgcgctgttcatcgccttcggtattacacagcaccaggctgtagccacgctcaaagcagctgcgctcgacgccgcgcaccagctcggaatagaaagggttggtactggcggtgatcagcatgccgatagtacgggtctggttgatcttaaggctgcgcgccagcgccgaaggggcgtagttcaggcttttgatcgccgcgtccactttcgcggtgatcgcctcgctgacgaaccggtctttattaatgacgtgcgagacggtggaggtggacacgcccgccagtcgggcaacatctttcatggttgccatgagaggttacccctgctgcgccagaaaatcgtcgatctcactgcgccacggcacggaaggctgcgcccctttacgcgttaccgcgatggccgccgccgcatgggcgaaacggatcgcctgctcaagcggcttgttttccagcagcgcggtcatcagcgcgccgttaaaggtgtcaccggcagcgatagtatcaatggctttcactttaaagcccggaatgcgctggccttcgccgttaacgctggcccacacgccgcggctgccaagcgtaatgatgacggtttcgatgcctttgctatgcagcgcctgcgcggcgcgcgcggcatcgtcatccgtttccactttaatgccggtcagtttttccgcttcggtttcgtttggcgtgatcacatccaccagcgccagcagctcgtcagacagctcccgtgccggagccgggttgagcgccacgcgcgtgcggttctggtgagcgatttttgccgccgccagcacgctttccaccggcgactccagctgcatcagcagcgcggatgccgcggcgatacgatcgcgctgcgcttcaaccagcgccacagagagcgcagcgttagcgccagcatgaataccgatgacattctccccttcaccgttcacaaaaatcagcgccacgccggtggattcaccagtgatgacgctgaccggcgtaacatcaatgttgtcgctcgccagctgtgtacggacccgttcgccagtgtcgtcgtcgcccgtgcaggcgataaacgcaatatctgcgccgctgcgtccggcagcaaccgcctggttggcgcctttaccgccaaaagcgacctggtactggctgccggtgacggtttcacccggtgtcgggaaggattcaaggttgagaatgtgatcggcattaatactgccaaggacgatgagtttacctgccatgttcatagtttcatcctgtaaatgcgccgccctgagcggcgcgtgccctgcttttcttatgttctttttcctgccgccacacgcggcggcaggacaatcacattactgtttgataaccagtttcagatcaaccgggtatttcgcctgtactttctcgcctttgatcactttgtcagcggtttcaacacctttcgcgccgatttgctccggtaactgggcgatggtcgccgccagtttgccgtcgtttaccgctttttcaccgtctggcgtaccgtcaaaacccaccaccattacgtcagttttaccggcggtttgcagtgcgcgcagtgcgcccagcgccatttcatcgttctgcgcgaacaccgctttcacgtccgggtgcgcagtcagcaggttctgcataacgttcaggcctttggtgcggtcaaagtcagccggctggctggccagcacgtcgaatttgtgggccgcaacggcctgctggaagccttcgccacgctcacgcgccgcggaagtaccggcgataccctgcagttcgatcacttttgcgccttcaccggcttttttagcgatgtagtcgccagcgattttgccgcccagcacgttatcagaagcgatgtggctgaccacctcgcctttggcggccatacggtcgagggtgatcaccgggattttcgcctcgtttgccatcttcacggcattacctaccgcgtcagaatcggtcgggttgatcaacagcagtttggtgccacgtacggttaaatcctgaacgttcgccagctctttcgccgggttgttctgggaatccagcaccaccaggttgtagcccagtttatcggcttctttttgtgcgccgtctttcagggaaacgaagaacgggttgttcagggtggagaccaccagcgcgatggtgtctttcgccatcacattcgcgcttacggtcgcactcagtgctacagcagaaaccagggtagccagttttttcatgttcatattcagatgtcctgtaatgtcattgattactgttttttgttgtctaccaggaccgccagcaaaatcaccactgctttaacgatcatctggtaataggaggaaacacctagcaaattcaggccattattgaggaagcccagaatcaatgcgccgataagcgtgccgacaatccggcctttaccgcccgcaaggctcgttccccccagcaccaccgccgcgatggcatccagctcgtagccggtgcccgccgtcggttgggcggaggagagacgcgcaacttcaataatgcccgccagagaagccagaaggccgctcagcgaatacacgataatcttgattttattcacactgatgccggacagacgcgttgccgcttcgttaccgcccagcgcatagatataccgaccaagacgggtgtgatgcaacacataccatgcggcaaggaagacaaaccccatgatccacaccggcgccgggatccccagcggacgaccgataccgaaccagccaaacagatcggcgttttccgtaaagcccgtattcatgggactgccgttggtataaaccatggtcgcgccgcgcagcagcagcatcatcaccagcgtggcgataaaagcctgcacgcggcctttcgcgacgatcgccccggtcatggccccgatagccgcgcctaatgccagcgccgccgctacagccaccagcgcattcacttccatccccaccagcgaggcagccactgcgccggtcagcgccagtaacgaaccgacggacaggtcgatcccggaagtaagaatgaccagcgtcatccccaccgccataatggcgttaaccgacgtctgttgcaggatattgaacaggttattaacggtaaaaaagttcgggctaagggtggagacaatcgcaatcagcaccagcagggcaatcagcgatttttgttccatcagccacgctttgttgaaatagcggcgggtagaaacggtttgggtactcattgcctggactcctgcgtatcgcgatttagcttgccgacggcggccgccatcagcacttcctgggtggcctgttcgcgggtgaattctccgcccagatgcccttcatgcatcaccatgatgcggtcactcatgccgatgacttccggcatttccgacgacaccagaatgatgctcaacccttcagccttaaactgattgattaactgataaatttctttcttagcccccacgtccacaccgcgcgtgggttcgtccagaatcagcactttcggacgcgtcatcagcccgcgggcgatggcgaccttttgctggttcccgccggaaagcaggccaatcggctgctccattgacggcgttttgacgttaaacagacggacgaaatctcccaccgcctgctgttcatctttatgcttcaggcgaccaccggcgtgactgaaatagcgcagcgcggtaagcgacatgttttctttaaccgacatgcccagcaccagcccgtcgcgcttgcgatcttcggagatatacacgatgccgttcgccaggccatcctgcggtgagcgggtgaccacttcatggccatcgagggtgacataaccgctggtgcgcggcagcgcgccgtacagcactttcatcagttcagtacgtccggcgcccatcagccccgccacgcctaagatctcgcctttgcgcagcacgaaggagacgttatcaacgcccggcccgcacacggcatccactttcaggcgcacatcgccgggggctttatcaagatgcgggtactgctcttccagcttacgtcccaccatcatttcaatcagcgtatcttcactcagcgtcgacacatcccgctcggcgataaactgcccgtcgcggaataccgtcacgtcatcgcagatttcgaagatctctttcatgcggtgggaaatataaacaatgccgcgcccctgggatttcagctcgcgaatgacgcggaacagggagtcggtttcggtatcagtcagcgcatcggtcggctcatccataatgatgactttcgactcaaagctcagcactttggcgatttccaccatttgctgatcgccaatcgacagatcgcccaccagccggtcgcttttaaagcgcaggttgagtttcgcgagcaggacgttggcttcggcatacatctttttccagtcgatcttgccgaagcgattaacgaactcgcggcctaaaaagatgttttccgcaatggtgagctgcgggatcaggttcagttcctgatgaatgatgccgatcccggcttcctgggaagatttaggaccggtaaaggtggtttcctggccgagccacagcagtgaacctgcatcacgctgataaatgccggttaagactttcatcatcgtggatttacccgcgccgttttcgcccaccagcgccataacgcggccgggataaacgttaagcgcagcgccggacagggcttttacgccggggaacgctttatcgatccccttcagttgcagtaatgcgtccatggcagcctcagaatgtgacgccagcgcagagaatgatattcgcatacggggaacactccccgctgcgaatcaccgcctgactgtctgcggtttgttgtttaaacgtttcgtgtgaaacataacgaacgtctatggtgtttccctggtgttgttgcagttgctctatgtggcggagcaacgtttcgtggagttgcggattatgatctttaatttccgtcgcgagaatggccgcctcaacctgcatttccgtcgtcacgacctccagcacctgcataaaggagggcacgccctgagtcagcgccatatcaatgcgctgcgtgctatggggcaccggcaatccggcatcgcacacgaccagcgtatcagtatgtccaagacgggaaattaccgacgaaatgtcagaattcagtacagaccctttcttcatatttatctccactagcgaaacgtttcgctaaagtgagtttatgctgaagggtgtgcagaaaaccatcacgacgtaacggaattgtgatcgccgtcgaaacgtttcgctaagtcaaatggagaaggataatgccaggcaatatgccgggtggcgctgcgcttacccggcctacggtctgtaggcccgtgcaagcgaagcgccgccgggcggaggcgttcagagattaaatctcaacctgcgttcccagttcaatcacccggttaggcgggatttcaaactgatcgggtgcacgcagtgcgttacgttgcagtaacaaaaacagcttgccgcgaagacgcagataccacgggcgtttgccgaggatcagcgactcatgggacataaagaacgaggtttccatcatccggcagctcaggccttccagcccgcagcggtggaacacctcttccacgttgggaatttcacgccagccgtagctggccaccacgcgccagaaagtcggtgacagctgctcgatctgcacgcgacggacgttatgcacataaggcgcatcttccgtgcgcagcgtcagcaggatcacacgctcatgcagcactttgttgtgtttgagattatgcagcatggcaaaggggatgacgttcagcgcacgggacatatacacggcggtgcctggcacgcgcaccggcggcgatttctcaagcgaagcgatcatcgcttccagggaattgccgtgctcgtgcatgcggcgcagcagacggaaccgctcgcttttccaggtggtcatgatgataaacatcaccatgccgagactcaacggcagccagccgccggagagcagtttatcgaggttcgccgagaacagcggcacatcaatacacaggaaggcgaccagcaggaagcccaccagcaatttgttccagtgccagttttttcgcgccacggtcgccgacaaaatagtggtcagcaccatggtgccggtcaccgcaatgccgtaggccgccgccaggttgctggaatgctcgaagctgacgataacaatcaccaccgcgcaatagagcagccagttcacgaacggaatgtagatctgcccggattccatttccgaggtatgaatgatgcgcatcggcgacaaatagcccaggcgcaccgcctggcgggtcagggagaagacgccggagatcaccgcctgcgaagcgataaccgtcgccagggtggcgataatcagcataggtattaacgcccattcaggcgctaacaggaaaaacgggttcttgattgcttccggcgttttcagtaacagcgcgccctgcccgaaatagttcagcaccagcgacggcagcaccagactgaaccaggccacccggatcggcagcttgccgaagtgacccatatccgcgtacagcgcttccacgccggtaatcgacagcaccaccgcgccgagcgccacaaaagagacggctttatattcaaggaagaaatgcaccgcccatgccggattcagcgcctgcaacacttcagggttgccaataatcccgcgcagtccgagcaccgccagaatcaaaaaccacgccagcatgatcggcgcaaagagtttgcccaccagcccggtaccgtgcttctggatcataaacagcagcgtcaggacgatgatcgacagcggcaccacccaggtttccagtgacggtgcgacgatctccagcccctcgatcgcggacatcaccgaaatcgctggtgtgatcaccacttcaccatagaagaagctgccgccaatcaatcccatgatcaccagcaccgaggtcatacgggccgaggtgttacgcccggccagcgacatcagcgtcaggatcccaccttcaccggcgttatcggcgcgcattacaaaggacagatatttaacggatacgaccaggatcagcagccagaaaatgagcgataaaaagccgaacacggcatcgcgctcaacgccaaagccaaactgaccagacaaacattcacggagggtataaagcgggctggtaccgatatcaccgtacaccacgccgatggctgcgagcgttatcgcaggcaacgattgcttattatctgtgctcatagactaatcttttgtttgaatgccaactgtgtgcttagtcccttggcccacaaaagcgcacagtatgcacgattctttgccaaatcgtacccctaaatgcggccgggttatcctgcctcaatgaaaatgaaccggtacttcagtctattacaagcccctgttgaaacgtttatactcgcagctctgcgcctgaaacccggcgaaaggaagtaaatgaattatggctcacccacacttattagctgaaagaatttcccgtctcagtgctgcactggaaaaagggctttttgagcgcagccacgcgatccgcttatgcctgctggcggcgctcagcggcgagagcgtctttctgctcggcccaccgggaatagccaaaagccttatcgcccggcggctgaagttcgccttccgccatgcccgggcttttgagtatctgatgacgcgcttttccacaccggaagaggttttcggcccgctgtcgatccaggcattaaaagatgaagggcgttatgaacgtcttaccactggctacttaccggaagcggaaattgtctttttagatgagatctggaaggccggtccggcgatcctcaacacgttgctgacggccatcaatgaacgtcgtttccgcaacggcgctacggaagaaaaaatccccatgcgtctgctggtggcggcgtccaacgaactgccggaagcggacagcagcctcgaagcgctgtacgaccgtatgctgatccgcctgtggctggataaagtgcaggacaaggggaatttccgcgccatgctggtgagccagcaggatgaaaacgacaatccggttgccgatgccctgcagatcagcgacgaagagtatcagcagtggcagcaggacattggaaaaattgccctgcccgatgccgtctttgaactgatcttccagctgcgccagcagctggatagtctgccgaacgccccttatgtttccgatcgccgctggaaaaaagccattcgcctgttacaggccagcgcctttttctccggacgcgatgtcgtcgcgccgatcgatctgatcctgctcaaagactgcctgtggcatgacgcggatagcatgaatctgcttacacaacaaatagatattttgatgaccgttcacgcatggcagcaacaggcgatgctgacgaaactggcggccatcgggcagcgccgtcttcagctgcaacagcagcaaagcgataaaacggcgctacgggttctgcgtcagagcggcatgttcagccgccgcccgcactatgaactgccgccggaacttaccgacgcgaccctgacgctgcttcttcagcagccgctgaaactgcatgatatgcaggtgatccatctgaccattgagcgggccgcgcttgagcagtggctggcgaaaggcggggagatccgcggcaaacttaacggcattggttttgcacagttgctgaacctggaagtcgacagcacattacatctgatagtgcgcgacgtcagcctgcagggatcgcgccttgccctgccgggcagcgcgcaggaaaacgtgccggatgagatcactcaccagctggaagcgctggaaaatgaatggcaccagcagcatacgcgcttcagtgaacagcaaaaatgcctgtttattcacagcgactgggcgggtcgtattgaaggcagcctgcaggacgttggcgcgcagatcaaacaggcgcgtcaatgctgacgctggataccctcaatgtgatgctggcggttagcgaagaggggatgattgaagagttgatcgtcgccctgctggcctctccgcagctggcggttttttttgagaaattcccccgtctgcgccatgccatcaccgaggatattccccgctggcgggaggcattaaagggacggctgaaagacacccgcgtaccgccggagttgacggaagaagtgatcagctatcagcaaagccagctgctctccaccacgcagttgaccattcagctgccacagatcctcagcctgctggaaaaagtccactccccctatgccgcccaggcaaaacagctggtagcggataacgccacctttacccccgccctgcacacgctgtttttgcagcgctggcgcttaagcctggtggtgcagaccacggcgctcaaccagcaattactggaagaagagcgcgagcagttgctcagtgaagtgcaggagcgtatgacgctgagcgggcagctggatccggtgctggtggaaaacgacaatgcggccgggcggctgtgggatatgagcgccggacagcttaagcgcggcgactatcagctcataataaaatacggggattttctggccgcgcagcctgaactgaaaaagctggcggaacagctggggcgatcgcgtgaggcgaagtccgtaccacgcaacgatgcgccgatggaaaccttccgcacgctggtgcgcgagccgtcttcggtgcccgaacaggttgatggcctgcaacagagcgatgatattttacgtttgctgccaccggagctggccacgctgggcatcagcgagctggagtatgagttttatcgtcgcctggtggagaaacaactgctgacctatcgcttacagggcgaagcctggcgggagaagatcaccgagcggccggtggtgcatcaggattttgacgagcagccgcgcgggccttttatcgtctgcgtcgatacgtccggatcaatgggcggttttaatgagcagtgtgcgaaagcgttttgcctcgcgctgatgcgcgtggcgctggcggatcgacgccgctgttttatcatgctgttttccagcgaagtggtgcgctatgagctgtcgggcagggaaggcattgagcaggcgatccgctttttgagccagcgttttcgcggcggcaccgatctcgccagctgttttcgcgccatcatcgagcggatgcagggcggcgagtggttcgatgcggatgcagtggtgatctccgattttatcgcccagcgcctgccggacgaggtgatcggcaaaattaatgaactgcagcgcgtccatcagcatcgctttcatgcggtggcgatgtccgcccacggcaagcccggcattttgcgcattttcgatcatatctggcgctttgataccgggatgcgcagccgcctgctgcgacgctggcggcgctgaatcagagcagggatgagacgctgtcgcgtacctgcgcaggccatacgccgcactgtacctggccaatgtgcggcagttgcagcagcaacatggtcagacgtgactggccaatgccgccgccgatagtctgcggcatttgcccttccagcagcgcgcggtgccactccagcgccagacgatcttcatcgccggtcagcttcagctggcgtttaagggtttcggcgtcaacgcggatgcccatggaggagagctccagcgcatcttccagcaccgggttccacaccaggatgtcaccgttcagaccggcaaaaccggcttcggtgcgggtcgtccagtcatcataatccggggcgcgcacgtcgtgacgtttgccgtcgctcaggtcgccgccgataccgatcaggaacaccgcgcccagctctttcgcaatggcccgctcgcggcccttggcgtcgagaccagggaagcgggtcagcagctcttcgctgtgcacaaagtggatctgctctggcaggaacggtgcctgaccaaactccgcgctcactgccgcttctgtcgctttaatgcctgaccagatcgccgagacggtcgctttcagcgtgcccagatggcgctcgccgtcaccgaggacgcgctcccagtcccactgatcgacatagaccgagtggatcggcgtaagacgatcttcgtccgggcgcagggctttcatgtgcgtgtaaagcccttcccccgcgctgaagtcgtgttgtcccagcgtctgccgtttccacttcgccagtgagtgcaccacttcaaagcgcgcgtctggcagggttttcacattcacctgtaccgccttttcgcaaccagacaggttgtcctgcgtgccatcccccacgcggctgaggatcggagcctgaacttcgatcaggcccagtttttcctccagctggcgggagaagtgagctttaacgaaactgatctggcgttgttttgcgatgtaagcggttttcattattgaactcctgtgtcctgttgccattgattaagcaacaaaacgagagcgatattcaataatcaacagataaaaagcccggttcacttttgattccataaaatatggcgttaaactggactgaatcattaatctacataagaaaaacctatggaaaattatcagatcgataatctggatcgcggcatccttgaggcgctgatggcaaatgcgcgcacggcttatgccgaactcgccaagcagtttggcgtcagccccggcaccattcacgttcgcgtggagaagatgaaacaggcgggcatcattaccggcgcgcgtatcgatgtctgccctaaacaactcggctacgacgtctgctgctttatcggcatcattctcaaaagcgccaaagattacccctcggccctggcgaggctggagagtctggaagaagtgaccgaagcgtattacaccaccgggcactacagcatctttattaaggtgatgtgcaaatcgatcgacgcgctgcaacaggtacttatcaacaagatccaaacaattgatgaaattcagtccaccgaaacgctgatctcgctgcagaacccgatcatgcgcaccatccgcccgtgatcctctgaaataatcaccctgttttccacaggtagatcccagctcattcacagcgtacaatatgccacgcttaattgaggacggacgatcatggcagatattacgcttatcagtggcagcaccctgggcggagcagagtacgtggcggagcacctggctgaaaagctggacgaggcggggtacagcaccagcacccttcacggcccgctgcttgaggatctgccggtagaaggcgtgtggctgctggtttccagtacccatggcgcaggcgatctgccggataacattcttcctttatatgaagaactgaaagaacagcagccggatctgtctcaggtacgctttggggcgatcgggatcggcagtcgtgaatacgacaccttctgcggggcgatcgacaagctggaaagcgaaatgcgggcttgcggggcaaaacagatcggcgaaacgctgcggatcaacatcctcgatcatgatattcccgaggatccggcagaaatctggctgggatcctgggttaatttactcaatattgtgtaaagatcgtgcgatcagttgtgtataagtctggttaaaagcttggatcaaccggtatttatccactgtataaggtttgacgagtttttgggctgtgcataacccttcattttgatcccagcttatactgagtgggatcaccgatcattcacaggtaacgatcctttctaatgtattgatcttcaaagccggatccgggttatccacagagaggcacgatcctaataagagatcatagtaaaaaagatctctaaaagaaaaagatctcttaataacagtcaggatcccgactctttctcgatgggctaaagttgagtagaatccacggcccggcaccaatccactttctaaccgctcaggcgaggcaaaccaccatgttttatccggatcctttcgacgtcatcatcattggcgggggtcatgcaggcactgaggccgcaatggccgctgcgcgtatgggtcagcagaccctgcttttgacacacaatatcgacaccctgggacagatgtcgtgcaacccggcaatcggcggtattgggaaaggacacctggtaaaagaagtggatgcgctgggcggactgatggcaaaggccatcgatcaggcaggcattcagtttaggatactaaacgcgagcaagggcccggccgttcgcgccacccgtgctcaggcagaccgcgtgctttaccgtcaggcagtgcgcacggcccttgagaatcagccgaacctgatgatcttccagcaggcggttgaggatctgatcgtcgaaaacgatcgtgtcgtcggtgccgtgacgcaaatgggcctgaagttccgtgctaaatctgtcgtactgacggtcggcaccttcctcgacggtaaaattcatatcggcatggataactacagcggtggtcgcgcaggcgatccgccgtcgatttccctttcccgccgtctgcgcgagctgccgctgcgcgtcagccgcctgaaaaccgggacgccgccgcgtattgacgcgcgaactattgatttcagcgtgctggcggaacagcacggcgacacgccgctgccggtcttttcgttcatgggcaatgtggatcaacatccgcgccaggtgccgtgctatatcacctacactaacgaaaaaacccacgacgtgatccgcaataacctcgatcgcagcccgatgtatgccggcgtgatcgaagggatcggcccgcgttactgcccgtcgatcgaagacaaagtgatgcgctttgcggatcgtaaccagcatcagatcttccttgagccggaaggcctgacctctaacgaaatttacccgaacggcatctccaccagcctgccgttcgatgtacagatgcagatcgtccgatccatgcagggcatggaaaacgcgaagatcgtccgtccgggctatgcgatcgagtatgacttcttcgatccgcgtgacctgaaaccgacgctggaaagcaaatttatcgctggcctgttctttgccggtcagatcaacggcaccaccggttacgaagaagcggccgcgcagggtctgctggccggtctgaacgctgcccgcttctctgccgaaaaagagggctgggcgccgggccgttccgaggcttatctgggcgtgctggtggacgacctgtgcaccctgggcaccaaagagccgtaccgcatgttcacctcccgcgcggaataccgtctgatgctgcgtgaagacaacgcggatatccgtttaaccgcggcgggtcgtgagctgggcctggtggacgacgaacgctgggcgcgctttaacgagaaactggaaaatatcgagcgtgaacgccagcgcctgaaagatatctggctgcacccgcagtctgaaaagattgacgaagtgaatacgaagctgagcgcgccgctgtcccgcgaggcgaacggtgaagatctgctgcgtcgaccggaaatgacctatcgcgagatggtgcagctgtcgccgtttgcgccgggactcagcgatgcgcaggccgccgagcaggtcgagatccaggtgaaatacgaaggctatattgcgcgccagcaggacgagatcgacaaacagcagcgtaacgagaacaccgtgctgcctgcgaccctggactaccgccaggtgagcggtctgtccaacgaagtgatcgccaagcttaacgatcacaaaccgtcatccatcggtcaggcatcgcgtatctccggtatcactcctgcggcgatctccattctgctggtgtggctgaaaaagcagggtatgctgcgccgtagcgcttaattcaactttacccgcccggtagcgctagcttaccgggcctacagaacccgtaaggcggattagcgaagcgccacccgccgttaagtatctaaacaggtaatcaccgtgctcaacaaactctctcgtctgctggatgaagccgatatttcgctcaccgatcaccagaaaaaccagctggtggcctatgtcgatatgctgcacaaatggaacaaagcgtacaatctgacctcggtacgcgatccgaacgagatgctgatccgtcatattctggacagcgtggtggttgcgccgcacctggcggggtcgcgctttatcgacgtgggtaccgggccagggctgccggggatcccgctgtcaatcgtcttacctgacgcgcacttcacgctgctggacagcctcggcaagcgggtgcgttttctgcgccaggtgcagcacgagcttcgcctgactaacatcacgccggtgcagagccgcgttgaggatttcccggcggagccgccgtttgacggagtgatcagccgtgcctttgcttccctgaacgatatggtgagctggtgtcatcacctgccggggcagggggggcgtttctatgcgctgaagggccagttgcctgatgatgaaatcgaaaaactaccggcagactttgcggtggaatcggtgatcaaattgcgcgttccgcaactggacggcgaacgtcatctggtgatgattaaaccaaacaatatttaatttttatcaaaaaatgttaattccgtactgtagtgaatgtgttaaaaatcagcacgcagaaacggaataaatcccgttaggcttaaccttatttttactgggatttttctgtttgttaacctggcattttttgttaaccggcaaaataatcaaccagggaagtatatgtctgctaaaaatcagtaatgcttaacgtttagcgatgttaaaaatttattaagaatgtcaataaaaggtttttgttgtatatgaagctgttttggaaatagtcgcagttattcatcttgaatatcagaaagatggtgactgtgattattatgcttcaatgaaagacgcttaaacgcaaatgcgcaatttgtgatctggtgcacgctttagcatcaggcttttcgcgcgattggcaatcctgttcgatggttcacactttacaaaaaagtggaaaaatagccctcgagaaatttatttaaacatttattcaccttttcgctacttattgtttgaaatcacgaggccgcaccgtataatttgctcgctttttgatgcttgactctgagccttaaagaacgttttatacgacacgcgacatacctcgttgggggcaggagtaaaaaacgtgatgtctttgtcgctcttgagtcgaaacgttgctcgtaagcttctgttcattcagttcctggcagtgatagcaagcgcattgctattttgccttaaagaccccttctggggcgtctccgcagtatgcggtgggctggcagtggtactgccaaatatgttgtttatgatttttgcctggcgtcatcaggcgcatacacctgctaaaggccgcatggcctggtccttcgccttcggggaagtgttcaaggtgttggcgacctttaccctactggtggtggcgctggcggttttgaaggcggtctttttgccgctgatcgtcacgtgggtttcggtgctggttgtacagatactggcacccgctgtaattaacaacaaagggtaagaggcatcatgtctgcaggagaaatctcaacaccgcaggagtacataggccaccatctgaataaccttcagattgacctgcgtaccttttcgctggtggatccgcataaccccccagccactttctggacgcttaacatcgactccatgttcttctcggtgcttctgggtctgttgttcctcgtgatgttccgtagcgttgccaaaaaagcaaccagcggcgttccgggaaaattccagacggcgatcgagctggtcattggcttcgtcaacggcagcgtgaaagacatgtaccacggcaagagcaaactgattgctccgctggccctgacgattttcgtctgggtattcctgatgaacctgatggatttgctgcctatcgacctgctgccgtatatcggcgagcatgtattcggcctgccggctctgcgtgtggttccgtccgctgacgtgaacatcaccctgtcgatggcgctgggcgtatttatcctcattctgttctacagcatcaaaatgaaaggcattggcggcttcaccaaagagctgaccttacagccgttcaaccactgggcatttattcctgtcaacttaatccttgaaggggtaagcctgctgtctaaaccggtatcactcggtctgcgactgttcggcaacatgtatgccggtgagttgatcttcattctgattgcaggacttctgccatggtggtcacagtggatcctgaatgtgccatgggccattttccacatcctgatcattacgctgcaagccttcattttcatggttctgacgattgtctatctgtcgatggcatctgaagagcattgattttaccaacactactacgttctaactgaaacaaactggagactgtcatggaaaacctgaatatggatctgctgtacatggctgccgctgtgatgatgggtctggcggcaatcggtgctgcgatcggtatcggcatcctcgggggcaaattcctggaaggcgcagcgcgtcaaccggatctgatccctctgctgcgtactcagttctttatcgttatgggtctggtggatgctatcccgatgatcgctgtaggtctgggtctgtacgtgatgtttgctgtcgcgtagtaagcgttgcttgattaagcaatttttagaacgttaaccagataagaggcattgtgctgtgaatcttaacgcaacaatcctcggccaggccatcgcgtttgtcctgttcgttctgttctgcatgaagtatgtatggccgccgttgatcgctgccattgagaaacgtcaaaaagaaattgctgacggcctcgcttctgcagaacgagctaaaaaggatttggaccttgcacaggccaatgcgaccgaccagctgaaaaaggcgaaagcggaagcccaggtaatcattgagcaggcgaacaaacgtcgcgctcagatcctggacgaagccaaaaccgaagcagaacaggaacgtaccaaaatcgttgcacaggctcaggcagaaattgatgctgagcgtaaacgtgctcgtgaggaactgcgtaagcaagttgctatcctggctgttgctggcgccgagaagatcatcgaacgttccgtggatgaagctgctaacagcgacatcgtggacaaacttgtcgctgaactgtaaggagggaggggctgatgtctgaatttgttacggtagctcgcccctacgccaaagcagcttttgactttgctgtcgaaacccaaagtgtcgatcgctggcagaacatgctggcgtttgccgcagaggtaacgaaaaacgaacatatggcggagatgctttcaggtgcactggcaccggaaactctcgccgcgtcgttcatcgccgtttgcggcgagcaacttgataccaacggccagaacctgatcaaggtaatggctgagaatggtcgtctgagagtgctcccggatgttcttgagcagtttgagcacttacgtgcccttagtgaagctaccgctgaagttgaagtaacctcggcgaccgaactgagtgaagaacagcttgcgaagattaccgccgcgatggaaaaacgtctgtcacgcaaagttaagctgaattgcaatatcgataagtctgtaatggcgggcgtaatcatccagtcgggtgatatggtcattgatggcagcgtacgcggccgtctacaacgcctcgcagacgtcttgcagtcttaaggggactggagcatgcaactgaattccaccgaaatcagcgaactgatcaagcagcgcattgctcagttcagtgttgtgagcgaagctcataacgaaggtactattgtttctgtaagtgacggtgttatccgcattcacggcctggccgattgtatgcagggtgaaatgatctccctgccgggtaaccgttacgctatcgcactgaacctggagcgcgactccgtaggtgctgttgtgatgggtccgtatgctgacctcgccgaaggcatgaaggttaaatgtactggccgtattcttgaagtaccggtaggccgtggcctgctgggccgcgtggtgaacaccctgggtgcgccaatcgacggtaaaggtccggttgataacgatggcttctcgccaatcgaagttatcgcaccgggcgtaatcgatcgtcagtccgtcgatcagccggtacagaccggttacaaatccgttgatgccatgatcccaatcggtcgtggtcagcgtgagctgatcatcggcgaccgtcagaccggtaaaaccgcgatggctatcgatgcgatcatcaaccagcgtgactccggcatcaaatgcgtatacgtggcaatcggccagaaagcgtccaccatctctaacgtggtgcgtaaactggaagagcacggcgcgctgtccaacactatcgttgtggtggctaccgcttctgaatccgctgcgctgcaatacctggctccgtatgccggttgcgccatgggcgaatacttccgtgaccgcggtgaagatgcgctgatcgtttatgatgacctgtccaaacaggctgttgcataccgtcaggtttccctgctgctgcgccgtccgccaggacgtgaagcattcccgggcgacgtgttttatctccactcccgtctgctggagcgcgcatcccgcgtaaacgcggaatacgttgagaacttcaccaaaggtgaagtgaaaggtaaaactggctccctgaccgcgctgccgatcattgaaacccaggcgggtgacgtttctgcgttcgttccgaccaacgtaatttctattaccgatggtcagatcttcctggaaaccaacctgtttaactccggtattcgtccggcggttaacccgggtatctccgtatcccgtgttggtggtgctgctcagaccaagatcatcaagaaactgtccggtggtattcgtaccgcgctggcacagtatcgtgaactggctgcgttctctcagttcgcatccgatctggatgaagctacccgtaaacagctgagccatggtcagaaagtgaccgagctgctgaaacagaaacagtatgccccaatgtctgttgcacaacagggcctggtgctgttcgcggctgaacgcggttacctcgaagatgtggaactggcgaaaatcggtagcttcgaagccgctctgctggcttacgttgaccgtgaccacgctccgctgatgcaagagatcaaccagtccggtggctataacgacgaaatcgaaggcaagctgaaaggcatcctcgattccttcaaagcaacccagtcctggtaacgtctggcggtctgtcctagggcagaccgcaaggcattgaggagaagctcatggccggcgcaaaagagatacgtagtaagatcgcaagcgtccagaacacgcagaagatcactaaagcgatggagatggtcgccgcttccaaaatgcgtaaatcgcaggacagaatggcggccagccgtccttatgcagataccatgcgcaaagtgattggtcaccttgcgaacggcaatctggaatataagcacccttacctggaagaacgcgacgttaagcgcgtgggctacctggtggtgtcgaccgaccgtggtctgtgcggtggcttgaacattaacctgttcaaaaaactgctggcggaaatgaaagtatggtccgataaaggcgttcagagcgatatcgcgatgatcggctctaaaggcgtttctttcttcaattccgtggggggcaatattgtcgcccaggtgaccggtatgggtgataacccgtccctgtccgaactgatcggcccggtaaaagtgatgttgcaggcctacgatgaaggccgtctggacaggctgtacattgtcagcaacaaatttattaacaccatgtctcaggttccgaccctcactcagctgctgccgttaccggcatcagaagacggtgagctgaagcagaaagcctgggattacctgtatgaacccgatccgaaaccgctgctggataccctgctgcgtcgttacgttgagtcgcaggtttatcagggcgtggtagaaaacctggccagcgagcaggccgcacgtatggtggcgatgaaagccgcgaccgacaatggcggcagcctgattaaagagctgcagttggtatacaacaaagctcgtcaggccagcattactcaggaactcaccgaaatcgtcggtggtgcatccgcggtataaccaggttaattcgtagaggattcaagatggctactggaaaaattgtccaggtaatcggcgccgtggttgacgtcgaattccctcaggatgccgtaccgcgtgtgtacgatgctcttgaggtacaaaatggtaacgagagcctggtgctggaagttcagcagcagctcggtggtggtatcgtgcgtactatcgccatgggttcttctgacggtctgcgtcgtggtctggaagtaaaagaccttgagcacccgattgaagtaccggtaggtaaagcaacactgggtcgtatcatgaacgtgctcggtcagccgatcgacatgaaaggcgacatcggtgaagaagagcgttgggcgatccaccgcgcggcaccaagctacgaagaactgtccagctctcaggaactgctggaaaccggcatcaaggttatcgacctgatgtgtccgttcgctaagggcggtaaagtcggtctgttcggcggtgcgggtgtgggtaaaaccgtaaacatgatggagctgatccgtaacatcgcgatcgagcactccggctattccgtgtttgcaggcgtgggtgagcgtactcgtgagggtaacgacttctaccacgaaatgactgactccaacgttctggacaaagtatccctggtttacggtcagatgaacgagccgccgggaaaccgtctgcgcgttgcgctgaccggcctgaccatggctgagaaattccgtgacgaaggtcgtgacgttctgctgttcgtcgataacatttatcgttataccctggccggtacggaagtatccgcactgctgggccgtatgccttctgcggtaggctatcagccgaccctggcagaagagatgggtgtgttgcaggaacgtatcacctccaccaaaaccggttctatcacctccgttcaggcggtatacgtacctgcggatgacctgactgacccgtcgccagccaccacctttgcgcacttagacgcaaccgtggtactgagccgtcagatcgcgtctctgggtatctatccggccgttgacccgctggattccaccagccgtcagctggatccgctggtggttggtcaggaacactacgacaccgcgcgtggcgtacagtccctgctgcaacgttaccaggaactgaaagacatcatcgccatcctgggtatggatgaactgtctgaagaagacaaactggtggtagctcgcgcacgtaagatccagcgcttcctgtcccagccgttcttcgtggcagaagtatttaccggttctccgggcaaatacgtctccctgaaagacaccatccgtggctttaaaggcatcatggaaggcgaatacgatcacctgccggagcaggcgttctacatggttggttccatcgacgaagccgtggaaaaagccaaaaaactttaacgccttaatcggagggtgatatggcaatgacttaccacctggacgtcgtcagcgcagagcaacaaatgttctccgggctggtcgaaaaaatccaggtaacgggcagtgaaggtgaactgggtattttcccgggtcacgccccgctgctcaccgccattaagcctggtatgatccgcatcgttaaacagttcggtcacgaagagtttatctacctgtccggcggcattattgaagtgcagcctggcagcgtgaccgttctcgctgatactgctattcgtggccaggatctcgacgaagcgcgagctctggaagcgaaacgtaaagcagaagagcacattaagagctctcatggcgacgtggattacgctcaggcgtctgcggagctggccaaagcgatcgcgaaactgcgtgttatcgagttgaccaaaaaagcgatgtaacaccggcttgaaaagcacaaagccagtctggttgccaggctggctttttttatgcttccacgagaatgggttgataaatgaaatggtgtttcttattttttgtgattaacatcacaaaaatattgatcggtgaaaatttgaggtgtagacttatttttgtgaagtaagtcacataaacgaattcaaccgccgggaaaacatcatgaaactgattaacaaaattatcgctttcttcaacaacatgaacgtttcttttggtacttttaatctgtaatcacgtagtgccgccaattaaaacgacaaccgctggtggcgtgaacagacatcaataaaggtcgcccgaggcggcctttatgcttttaataattcagtcaaaatatcccccgttcgtacggcttcgcgccccgcttaactcctctatactcacctttgctgctgtcagcctggctacgttttctttattcattctgcgaaaaaataagtaaaacatcggcataacaactttacagcccgtgatatgttcattttttacggtaaatggcatcatgacggccggaaaacggggcgcagaaggggattattaccggtctgctggcatttaatctgcgacccaattcacggcgaaaaaaatgtagtattttcaatgtgaaaaagtaaaaattcaccctcaaattacagtcaggacgcgtatgttgaacagtgctatgagtgtggtcatccttgccgctggtaaagggacccgcatgtattccgatcttcccaaagtgctgcacacccttgcagggaaagcgatggtccagcatgtcattgatgccgcgaatgaactgggcgccagccgcgttcatctggtttacgggcatggcggcgatttgctgaagcagacattgcgcgacgataagctgaactgggtgctacaggctgaacaactgggcaccggccacgctatgcagatggctgcgccgaactttgctgataacgaagatattttgatgctctacggcgatgtgccgctgatttcggtcgccactctgcaacgcctgcgtgacgccaaaccgcagaacggcattggtttactgacggtaaatctcagcgatccaaccggctatggccgtatcacccgcgagaacggtaaagtgaccgggatcgtagagcacaaagatgccaccgatgagcagcgtcagatccaggaaatcaataccggcattctgatcgccaatggcgcagacatgaagcgctggctggcgaaactgaccaacaacaatgcgcagggtgaatactacatcaccgatattatctcgctggcttatcacgaagggcgtgaaattgccgccgtccacccggaaaggctgagcgaagtggaaggcgtgaacaaccgcctgcagctgtcccgtctggagcgcgtctatcaggctgagcaggctgaaaagctgctgctggcaggggttatgctgcgcgatccggcgcgtttcgatttacgcggctccctgacccacgggcgcgatgtggaaatcgatactaacgtcattctcgaaggtaacgtcaccctggggcatcgcgtgaagatcggcgcaggctgcgtgatcaaaaacagcgtgattggcgatgactgcgaaatcagtccttacagcgtggtggaagatgctgaactggccgccgcctgcaccatcggcccgtttgcgcgtctgcgtccgggtgccgagctgctggaaggcgcgcacgtcggcaacttcgtggaaatgaaaaaagcgcgtctgggtaaaggctcgaaagcgggtcatctcacctacctgggcgatgcggaaattggcgataacgtgaacatcggcgcgggcacaatcacctgcaactacgatggcgccaataagcataaaaccattattggcgatgacgtgtttgtcggctccgatacgcagctggtggcgccggtaacggtagccagtggcgcaagcatcggcgcgggcaccacggtaacgaatgacatcgcggaaaatgaactggtcatcagccgggtacgtcagacccatatcaagggctggaaacgtccggtgaagaagaagtaacaatgtggcgggtggtgcttcgctaacccgccctacggttttctgccggataaacgttagtgccatccggcaaaaagggatgaggagataaacatatatctcccgcccaccagcagtaaccataaaaataaccccactctctacaaggctcggggcgcccgatacgggcaaaacaggtcggcgacaacgcatcattatcaggaaattaactatgtgtggaattgttggcgcagtcgcgcagcgtgatattgctgaaatccttctcgaaggcttacgtcgtctggaatatcgtggttatgactctgcgggactggccgtcgtcgataacgaagggcacatgacccgtctgcgtcgtctgggtaaagttcagatgctgtctcaggctgcggaagaacatccgctccatggcggtacggggatcgcacatacacgctgggcaacccacggtgaaccttcggaagggaatgcgcacccgcatgtgtccgaacacattgtggtggtccataacggtattattgagaaccatgagccgctgcgtgaagtattgcaggcacgtggctacgtctttgcctccgaaaccgataccgaagtgattgctcacctcgttcactgggagctggagcagggcggcacgctgcgtgacgccgtgttacgtgccatccctcagctgcgcggtgcctacggtacggtgatcatggatacccgtcatccggatactctgctggccgcccgttccggcagcccgctggtcattggcctcggcatgggcgaaaacttcatcgcttccgatcagttagctctgctgccggtcacccgtcgctttatctatctggaagaaggcgatatcgctgaagttacgcgccgcagcgtgaccgtattcgataagtctggccatgaagttacgcgcccggacatcgaatctaatctgcaatacgacgcgggcgataaaggtatctatcgccactacatgcaaaaagagatttatgagcagccgaacgccatcaaaaacactctgaccgggcgtatcagccacggcgaagtggatttaagcgagctgggcgcgaatgccaatgacatgctgtcacaggttgagcatatccagatcgtagcctgcggcacctcgtacaactccggtatggtgtcacgctactggtttgaatccctggcgggcgtgccctgtgacgtggagatcgcctctgagttccgctatcgcaaatccgcggtgcgtcgcaacagcctgatgatcaccctgtcccagtccggtgaaacggcagataccttggccgcgctgcgcttgtcgaaagagctgggttacctcggttcgctggcgatctgtaacgtgccgggctcctcgctggtgcgtgaatccgatctggcgatgatgaccaacgccgggactgaaatcggtgtggcttccaccaaagccttcaccacccagttaacggtgctgctgatgctggtggcgaagttaagccgtctgaaaggcatggacgcgtccattgagcatgacattgtgcatggtctgcaggcgctgccgagccgtatcgagcagatgctgtcgcaggacaaacgcatcgaagcactggcagaagatttctccgacaagcatcacgcgctgttccttggccgtggcgatcagtatccgatcgcgctggaaggcgcgctgaagcttaaagagatctcctatatccatgctgaagcctatgcggcgggcgagctgaaacacggcccgctggcgctgattgacgccgatatgccggtcatcgtggtggcaccgaacaacgaactgctggaaaaactgaaatccaacattgaagaagtgcgcgcccgtggcggccagctgtacgtcttcgccgatcgtgatgccggtttcaacagcagtgacaacatgcacattatcgaaatgccgcatgtggaagaggtgatcgcaccgattttctataccgtgccgctgcagttactggcctatcacgttgcgctgatcaaaggcaccgacgttgaccagccgcgtaacctggcaaaatccgttacggttgagtaaataaatcaaagccccgtctgcaaaggcggggcttttactgtctgcgctgttctgtttttatacacatttgcggcacccttctttatgacaaactgtcatcttcagctacttttaatcctgtaataaaaataaaatcacgctgtcatgctctgttcataaatcttataattatttgattataatgattttattttggctatcccaccagcagccccgactgtcataaaactgtcatatttcatacattttactgtcacctgtttgtcctattttgcataccggagctactcaaacaacgatttacgaaatcttgcaggagtcattatgaaagccatgcgtaccactgtcgccactgttgtcgctgcgaccttatctctgagcgcttttgctgttaacgcagcagcaagcctgactggcgcgggtgcaaccttcccggcgccggtgtatgccaaatgggctgatacttaccagaaagccaccggtagcaaagtaaactaccagggtatcggctcctccggcggcgtgaagcaaattaccgctaacaccgttgatttcggcgcgtctgatgctccgctgtctgatgaaaaactggctcaggaaggcctcttccagttccctaccgtgatcggtggcgtggtgctggcggttaacctgcagggcgtgaaatccggcgaactggtgctggacggcaaaaccctgggtgatatttacctcggcaaaatcaaaaaatgggatgacgccgcgattgcgaaactcaacccaggcctgaaactgccttcgcagaacatcgccgttgtgcgtcgcgctgatggttccggcacctctttcgtgttcaccagctacctggcgaaagtgaacgaagagtggaaatctaaaattggttcaggctctaccgtaaactggccgaccggtctgggcggtaaaggcaacgacggcatcgccgcgttcgttcagcgtctgccaggctctatcggttacgttgaatacgcctacgctaaacagaacaacctggcttacaccaaactggtgtctgcggatggcaaaccggtatccccgaccgaagaaagcttctctaacgccgccaaaggcgtggactggagcaaaaccttcgctcaggacctgactaaccagaaaggcgatgacgcgtggccgatcacctccaccaccttcattctgatccacaaagagcagaagaaacctgagcagggcgcagaagtgctgaagttctttgactgggcttataaagatggcgctaaacaggcgaatgacctggattacgctaccctgccggacaacgtggttgagcagatccgtgcggcatggaaaaccaacgtgaaagacagcagcggtaaagcgctgtactaagcaaagtagttaatgatggcggatggcgctttcgcttatccgccctacaaaaatccgctaacatgctttttttgtaggcccggtaagcggcgacgccaccgggcatcgttcaaaacagagttcaactaaaagagtgacctatggctgcaactaagcccgcttttaacccaccgggtaaacaaggcgacatgatcttcagcgcactggtaaaactggctgcgctgattgtgctattgctgctgggcggcattattgtgtcgcttattttctcctcctggccaagcatccagaagtttggtttctctttcctgtggaccaaagactgggacgcgcctaacgatatttacggggcgttagtgccaatttacggcacgctggtaacctcatttatcgcgctgctgatcgccgttccggtgagtttcggcattgccctgtttctgactgaactggcgcctggctggctgcgtcgcccgctcggtatcgccattgaactgctggcggctatccccagtatcgtttacggcatgtgggggctgttcatcttcgcgcccttgtttgcgaaatatttccaggagccggtcggcaacgtactgtcgaacattccgtttgtgggcgcgctcttctccggcccggcattcggtatcggtattctggcagccggggtgatcctcgccatcatgatcattccgtacatcgcctccgtaatgcgcgacgtgttcgaacaaacgccggtgatgatgaaagaatcggcatacggcatcggctgcaccacctgggaagtgatctggcgcattgttctgccgttcaccaaaaatggggtcatcggcggcgtgatgcttggccttggccgcgcgctgggtgaaaccatggcggtgacttttatcatcggcaacacctaccagctcgacagcgcctcgctgtatatgcctggcaacagcattacctctgcgctggcaaacgaatttgcggaagccgaatccggcctgcacgtttcggcgctgatggagctggggctgatcctctttgtgatcacctttatcgtgctggcgatttctaaggtcatgatcatgcgcctggcgaaaaacgagggggcacgataatggcgacgctcgaaatgcaaaacaccacggctctggcggaatcacgtcgtaaaatgcaggcccgtcgtcgtctcaagaaccgtatcgcgctgacgctctcgatggcgaccatggcgttcggtctgttctggctggtctggatcctgttttccacggtgacgcgcggtatcgatggcatgtcgctggcgttattcaccgaaatgacgccgccgcctaatacggcgggtgggggcctggcaaacgccctggcgggcagcggcctgttaattttctgggccaccgcaatcgggacgccgctgggcattatggccggtatttatctggcggagtatggccgcaaatcctggctgtcagaagtgatccgtttcattaacgatattctgctctctgcgccgtcgattgtggttggtctgttcgtttacaccattgtggtggcgcagatggagcacttctctggctgggcaggcgtgatcgcgctggcgctgttgcaggtgccgattgtcatccgtaccacggagaacatgctgaaactggtgccggacagcctgcgtgaagcggcttatgcgctgggcacgcctaagtggaagatgatctcttccattacgttaaaagcctctgtttccggcatcctgaccggcatcctgctggccgttgcgcgtatcgccggtgaaaccgcgccgctgctgtttaccgcgctctccaaccagttctggagcacggacatgatgcagcctatcgccaacctaccggtgacaattttcaaatttgccatgagtccgtttgccgagtggcaggaactggcctgggcaggcgtgctgattatcaccctgtgcgtactgttgctgaacattctggcgcgcgtgatcttcgcgaagaagaaacacggttaatattttgcggcggggccatgggccgcgccgaatgaggaaagagtaaaatgagtatggttgagactgcatccggtaagatccaggttcgtgatttgaacttctattacgggaaattccatgccctgaaaaatatcagtctggatattgccaaaaaccaggtgacggcgtttatcggcccgtcaggctgtggcaaatccaccctgctgcgtacttttaacaaaatgtactcgctctacccggagcagcgtgcagaaggcgaaatcctgctggatggcgacaatattctcaccaatacccaggacatcgcgctgctgcgcgccaaagtcggtatggtcttccagaagccgacgccgttcccgatgtcgatttacgacaacatcgccttcggcgtacgcctgtttgaaaagctctcccgcaccgacatggacgagcgcgtccagtgggcgctgaccaaggccgcgttatggaatgaaaccaaagataaactgcaccagagcggttattcactctccggtggtcagcagcagcgtttatgtatcgcccgcggcatcgccattcgcccggaagtgctgctgctggatgagccctgctcagcgctggatcctatatccacaggccgcattgaagagctgatcaccgagttaaaacaggattacaccgtggttatcgtgacccacaacatgcagcaggctgcgcgttgctccgatcacacggcgtttatgtaccttggcgagcttattgagttcagcaacaccgacgatctgtttaccaagccggctaagaaacaaactgaagattacatcacgggtcgctacggctgattcaggagcacgctatggataaccttaacctcaataaacacatttccggccagttcaacgccgagctggaaagtattcgcactcaggtcatgaccatgggtggaatggtggagcagcagctctctgacgctatcaccgccatgcacaatcaggacagcgagctggccaagcgcgttgtggcaggcgaccagcaggtcaatatgatggaagtcgcaatcgatgaagcctgtgtgcgcatcatcgccaagcgtcagcctaccgccagcgacctgcgtctggtaatggcgatcatcaaaaccatcgccgagcttgagcgtattggcgatgtggccgacaaaatttgccgtacggcgctggagaaattctctcagcaacaccagccgctgctggtgagcctggagtcccttggccgccacacggtgcagatgctgcatgatgtgctggatgcgttcgcgcgcatggatctcgatgaagcgatccgtatttatcgcgaagacaagaaagtggatcaggaatatgaaggcattgtgcgccagttgatgacctacatgatggaagatccgcgcacgatcccaagcgtactgacagcgctgttctgcgcgcgctccatcgagcgtatcggcgaccgttgccagaacatttgcgaatacattttctacttcgtgaaaggtcaggatttccgtcacgtgggcggcgacgagctggacaaactgctcgccggcagcgatccgaaagagtgatcttttaaggccggatatccggccttaatttcagaacctgtaggccggataagcgtcagcgccatccggcattttttagcgggtaatatcccacccgcgcgccttccacaattccggcagctgcgccagatcggtaaaggtcgtcaccttcgggtggtcaaggggcttattatgcggatcggcgcagaagtagaacacttccatgcccgccgcgatgcccgcctgcgccccggccgaggaatcatccaccagaatacatttcgtcggatcgacgttcattgctttcgcggcgtggtacatcagcgccggatcgggtttccagcgctgaatatcgtagccgctgaacaataaatccgggaaatggtgcagcattcccagcttacccagcgaatgattcattttgcttaccggcccgttggacaccacacacatcggtacggtcatcgcgtccagcaacgcatttgcacccgcaatgacttcaagttcgctgtcgaacagacgtgcgacctcggcgcggtagacaggttcgagatcggctttcgccagatccacgccgttttcggcgttaacgatgtcgataatctcgtagagtttcacgcccttaaagcgtttaaatacctcctcaagatcaagcgtaatgccaaattcccggaacatatggacataagcccgggaacaaatcacttcactgtcgaccagcgtgccgtcacagtcgaaaaataccgcgtcaatttgggacatgccgtttcctgttttaatgcaattttaacgattacgtgatgcagattacgccgcgcaatcgttgccgtataagcaaaatcaatgaaaaaaaatgggtgatacccatcaccattgtcgcattttggtataggatagcgacggatttttccctcccatgtttggaaattgataatgagccaacaacacaccacccagccatcaggccaggggttgctcgaccgcgtgtttaaactgcgtgaacacggcacaacggcacgcaccgaagtcatcgccgggttcaccaccttcctgacgatggtctatatcgtttttgttaacccgcaaatcctgggcgccgctggcatggataccagcgcggtgtttgtgaccacctgtcttatcgccgcgcttggcagcattctgatgggcgtgttcgctaacctgccggtggcgctggcaccggcaatgggtctgaacgctttctttgcatttgtggtggtgggcgccatggggctgccgtggcaaatcggcatgggcgcgatcttctggggcgcgattggcctgctgttgctgaccattttccgcgtacgttactggatgattgccaatatcccggtcagcctgcgcgtgggtatcaccagcggcatcggtttattcatcggcatgatgggtctgaaaaacgccggtgtgatcgtggcgaacccggaaaccctcgtcaccattggtaatctgtcgtcgcacagcgtactgctgggcgtgctgggcttctttatcatcgctattctggcctcgcgtaatattcacgcggccgtgctggtttccattgtggtcaccacactgctgggctggatgctgggcgatgtgcattacggtggtatcgtttctgcgccgccgagcgtgaccagtgtggtcggtcatgtggatttagccggttcctttaatctgggcctcgcgggcgtgatcttctcgttcatgctggtgaacctgttcgactcctccggtacgctgattggcgtgacggataaagcgggcctggcggatgaaaaaggtaaattcccgcgcatgaagcaggcgctgtttgtggatagcgtgtcgtctgtggcaggctcattcatcggcacctcctccgtgaccgcgtacattgaatcctcgtccggcgtgtccgtgggtggccgcaccggtctgaccgcggtagtggtaggtgtgctgttcctgctggtgatcttcctgtcgccgctggcgggcatggtgccgccgtatgccgccgcaggcgcgctgatttacgtgggcgtgctgatgacgtcaagcctggcgcgggtgaagtgggatgatctgaccgaagcggtaccggcctttatcactgccgtgatgatgccgttcagcttctcgatcaccgaaggcatcgcgctgggctttatctcttactgcgtgatgaaaatcggtaccggccgtctgcgcgaactcagcccatgcgtggttgtcgtggcgctgctgtttgtgctgaagattgcctttatcgacgcgcattaatccttgctccctcatcctggcaaaatagccggggtgagggcagaccttctctcaggcaggcaaactgctgaaccgcatcaggcgcgccgcaggggcattcgcccgctgttgaatatccggcaggctgctccagccgcttttactgtcaaatgcccagatccgcagcgtttccatcgccggtgagacggctaccgaccagatcagcacatcctccgcatcacacaaggcttccaccggtgccgccagcgccgcccgcagacgacctgagcccggcagcaactgtaacagctccggcgagtcctgcgtctggctggccatctttaacacgctctgacgcagcgtgataagctgcgtctgggcttcattgggatcgttctggttaccgatccacagcttttcattgttagtgaagatctgccgttcctgcgcatgggggctgtgcagaccgcgcgtcgtccgctgtaactccatatccagcccacaaataccatcggtggtgatcgccacgccaaccatattcccggcgtaggcgagggaaaaatgcggtaactgcatatcaaaaaataccggacggccgttcggctggatgacgatgtccggcagttcgctgatgccgtaaagcataaacatcagttcagcgagtaacgcccgggaggcaagaaagcggtggcgctgatgttcaggtaattgacgtgcggcgtggtggcaggcagaaggcagcctcgttgaggtgagatgaccgtcggtcaggatccctcttgcaaagtgtgttgccatttttcgctccgtgataatggtctgaaggatcagacaacgaggatagctaatggcctgtattgtgcgcaggtttgattaaggaaaaaagaggatttgaaccgccgtgccggaattttacatttcctttaacagcaggccctgaaaacgaaaaaacccgccagaggcgggttttaaaatgctttgcttagaacggagaagcttacaggcttacaacgttaccagctgccgggcctttagcgccgctttcgatggtgaaggacactttctgaccttcgtccagagatttgtagccatcgttctggatagcagagaagtgtacgaacacgtctttagagccatcgtcaggagtgatgaagccgaaacctttatcagcgttgaaccattttaccagaccagtcattttagcagacatagaaattacctttgatattgaattagtgcctttcggcgcgatggtgtgcttgacagaatttttgaagcgattaagagaagctcacgacgaagggtatctttggataacttctggaggactactttactaactgctttaaaggtctgtgcgtcaaaccaatgagtctattaacgcacagatccttagtgagtagcaatgtttattttaaagagatcacttaccgatgcagaaactggagaagatccggcccagcagatcgtcggacgtgaactcgccggtgatctcgcttaacgccagctgcgccagccgcagctcttccgccagcagttcgccagcccatgcgccgagcagttgcgccttaccctgttgcagatggtcagccgccagttccagcgcctgtaaatgacgacgacgcgccataaagccgccttccatacgcgtatcaaagcccatgctggctttaagatggtggcgcagtacatccacaccctcgccggtgcgcgcggagaggcgcacaagtgagtgaccattcacatcactgatgcccagcgtctcgccggtgatgtctgctttgttacgcaccacggtaataggtaactttgccggcagccgggcgataaaatcgggccagatttctgccggatcaactgcgctggtggtggtgccgtccaccataaacaatacccggtcagcctgttcgatctcctgccaggcgcgctcgataccaatacgctcgacttcatcgctggcttcgcgcagaccggcagtatcaatgatatgcagcggcatcccgtcgatatgaatatgctcgcgcagcacatcacgcgtggtaccggcgatatcggtgacaatcgccgcctcacgcccggccagcgcgttcagcaggctggatttaccggcattcggacggcctgcgatcaccactttcatcccttcccgcagcaggctgccctgacgcgcttcagcgcgaacggcatccagatcgccaatcacctcgttaagctgcgcttcgattttaccgtcagagagaaaatcaatttcttcgtccggaaagtcgatggccgcttcaacgtaaatgcgtaagtgagtgagtgcttccaccagatgattcacgcgggcggaaaacgcgccctgcaacgagttcagcgccgagcgtgcggcctgttctgagctggcgtcgatgagatcggcaatggcctcggcctgggccagatccagcttatcgttgaggaaggcgcgttcagagaactcgccaggccgcgcaatacgcacgccggggatcttcaggatgcgttttaacagcagatcgagaataaccggtccgccgtgcccctggagttccagcacgtcttccccggtaaaggagttggggccggggaaccacagcgcgatcccctgatccagcgcgctgccatcaacatcctgaaacggcaggtaatcggcgtaacgcggcttcggcagcttgcccagtacaacgtcagccacttcccgcgctttaaggccagagatgcgcagaatgcccacgccaccgcgtccagggggggtggcctgcgcaacgatagtgtcgttatggctcatgatttatctctttaaaaccaataaaaaaggcggtcaatcgaccgccctgtcagaacttttctgtttgccgggtggcgctttgcttacccggcaaacatgacgtcaggagcttttcttctcgcggctatgcaggccacgtttctccagaccacggtaaatcatctgttgttgcagaatggtcaccaggttgctgacgatatagtacagcaccagaccagacgggaaccacaggaagaacaccgtaaagatgaccggcataaaggtcatgattttctgctgcatcggatcggtaacggtcgtcggcgacatcttctgaatgaagaacatggtcacgcccatcaggatcggcagaatgtagtacgggtcttgtgcggacaggtcatggatccacagcgcgaacggcgcatgacgcagttcaatggagcccatcagcatgtagtacagcgccaggaagattggcatctggataagcagcgggaagcagccgcccagcgggttaaccttctctgctttgtacagcgccatcatttcctggctctgacgttgcttgtcatcacccagacgctcacgcatggcctgaattttaggctgcagcatacgcatcttcgccatggaggtgtactgcgctttggtcagcgggtacatgatgccacgaacgataaaggtaataacgatgatggagaagccccagttacccaggaagctatggatccatttcagcagtttgaacagcggctgagagatgaaccacaaccagccgtaatccacggtcagatcaaggtgcggcgcaacagcagccattttgtcctgaatttccggacccacccacagggtgctgctcagcgcaccggtttgacccggctgaaccagaaccggcgcagacttatagccgatagcggcaacgccattgcccaggttgttggtgtagaaattgtttgccacgtcgttacgcggaacccacgcggttgcgaagtactgttgcagcatcgcaacccagccgccgtttgcggtgacgttcaggttttcgttgtcggcaatagtatcgaatttatatttttcgtacttctcatctggcgtggagtacgccgcgccacggaaggtatgcagcgcaaagttgctgcttccggtgtcacgatgagccggcagattgatggattgcttcagctggccgaaggttgccacttccagcggtttcgcgctgctgttctgcacgttgtagccaacgttcaccgcatactcaccgcgtttcagcgtaaaggttttggtgaaggtgttgcctgccgcgtcggtataggtcattgggatcgccagttcgttctggccatccgccagcacaaaggcgtcactggtgacgttatacagcggacgtgcgccgttagccggattatccgggccatcacgacctgtcaggccgctttgtgcctgatagatgaactccggggtggtttccagcaactggaacggctcagaagaacccagttctttcggataacctaacagctgcgcttgttcaacatcaccaccacgggtgttgatggtaagagacagcacatcggtcttaacggtaatcagttttccctggccactggctggtacgccctggtctgcggcgctacccgctgcggtggtcgtagtctgcgtggtctgctgcgcctgaggctgaggatttttatcctgctcccaggcttgccagatcatgaaagacacgaacaacaaagcgatgacaagaagattgcgttgcgaatccatcgttagtgttctctggtattaaaaggtcctggcgggacggggtcgtcgccacccgggtgtaaagggtggcattttaatacgcgtttcaccgtcaaccaactgccttttatcactccaaacctgcgcaatgcctcaattccgtaggccgaacaggttggagtgaaacggcaatgtggcccgagtagcggactaatcaggcgttgataaaccctaataagggctatcaggagccttgagccaggcgacagtggcggcgccataatttttccaacgcttccgagagagcacggttatcgaggtcagcaaccccctttttcgccaccaccacgaaatccattgctgggagttcatgctgacgtaaacggaagctttcgcgcgtcaggcgtttgatcctgttgcgttcatgcgcacgtttaacatttttcttggcgacggtaagaccgatacggggatgccccagcgaattcaggcggccgaggatggtgatttgcggcgtgccagcccgttgtggctgctggaagacgaatgtgaaatgattgggagttaacaagcgtaactccctgggaaatgcgagcttaaccacgcagggttagctttattacttggaaacggtcagacgagcacggcctttagcacgacgacgtgccagaacctgacgaccatttttagtagccatacgagcgcggaagccgtgagagcggttgcgcttcagtacagacggttgaaaagtgcgtttcatggcgatttctacctaaacttgaatgatttcactgacttttgcgcctgctcgtttggcaaggccaactgcgtacgcttcagtgttggtgaataaagaggccggattgtaataattgtacactccggagtcaattctctttccttatatcccgcgtattttcgcatgattctgtctgtaaaatgaacagccttaaacgacaaaaatcatacgctgcgcgccgggtggaggattatacgggctggcgacgaaagcgcaaggatcctcaaggatcttcctgagatcaattaagcaaaattttggcgttgctcagcatattttccaatatgcaggctaaatcctgccgcaccctgccaggatcgtttacacttacccggttcggatcgacctgtggataaatggtgaagaatctgtgagaaacacaagatctcttcggctgtttacgttatgatccgcggtcccgatcgcgatcctcgatcgtaaaaagggacaaatcgcaaatagcggttcgcacgtcacccttcaggggtctttcagagaccttttcgacgtgtgtcaacaatcatgaatattcagcctttgtcattttatcgactttgttcgagtggagtccgccgtgtcactttcgctttggcagcagtgtcttgcccgattgcaggatgagttaccagccacagaatttagtatgtggatccgcccattgcaggcggaactgagtgataacacgctggctttgtatgcgccaaaccgttttgtgctcgattgggtaagggataaataccttaataacatcaacgggctgctcaatgatttctgcggtactgatgtcccccagctgcgttttgaagtgggaaccaaaccggtcacgcagaccgtcagggagacggtgaacgtcgccgcgcccgcgcaggtggcggcggtgcataccccgcgccccgcgcccgcacgctcaggctgggataacgtcccggctcccgcggagccaacctatcgctccaacgttaacgtcaaacacacctttgataacttcgttgagggtaaatccaaccagctggcccgcgctgcggcccgtcaggtggcggataacccaggcggcgcgtataacccgctcttcctttatgggggaacaggtctgggtaaaacgcacctgctgcacgcggtaggcaacggcatcgtggcgcgtaagccgaacgccaaagtggtgtatatgcactccgagcgttttgttcaggacatggtaaaagccctgcaaaacaacgcgatcgaagagtttaaacgctactaccgctccgttgacgccctgctgatcgatgacatccagttctttgctaataaagaacgatcccaggaagagtttttccacaccttcaacgctttgctggaaggtaatcaacagatcattctcacctcggatcgttatcccaaagagatcaacggtgtcgaggatcgtctgaaatcccgcttcggctgggggttgaccgtcgcgatcgaaccgccggaattagaaacccgtgtggcgatcctgatgaagaaggccgacgaaaacgatattcgtctgccgggtgaagtggcgttctttatcgccaagcgtctgcgctcaaacgtacgtgagctggaaggcgcgctgaaccgcgtcattgccaacgccaactttaccggtcgcgccattactattgatttcgtgcgggaagccctgcgcgatctgctggcgttacaggaaaaactggtcaccatcgacaacattcagaaaacggtggcggagtattacaaaattaaagtggcggatttgctgtccaaacgccgctcccgctcggtagcgcgtccacgccagatggcgatggcgctggcgaaagagctcaccaaccacagcctgccggaaatcggcgatgcctttggtggccgcgaccacactaccgtgctgcatgcctgccgtaagatcgagcagttgcgtgaagaaagtcatgatatcaaagaagacttttccaatttaatcagaacattatcttcgtgatgcgatgaaagtgacgctatgaaatttaccgttgaacgtgaacatttactcaagccgctccagcaggtcagcggcccgctgggtggtcgtcctacgctgcctattctgggtaacctgttgttgcaggttgctgacggcgcattgtcgctgaccggtaccgatctggaaatggaaatggtggcccgcgtcgcgctgctgcagccgcacgaacccggtgcgaccaccgttccggcgcgcaaattctttgatatttgccgtggcctgccggaaggcgccgagatcgccgtacagctggagggcgaccgtatgctggtacgctccgggcgcagccgtttctcgctgtcgaccctgccggcggcagacttcccgaatctggacgactggcagagcgaagtggaattcaccctgccgcaggcgaccatgaagcgcctgatcgaagcgacccagttttccatggcgcatcaggacgtgcgttattacttaaacggtatgctgtttgaaaccgaaggcgaagagctgcgcaccgtggcgactgatggtcaccgcctggcagtctgttccatgccggtcgggcagtcgctgcccaaccattcggtgatcgtgccgcgtaaaggcgtgatcgagctgatgcgtatgctggacggcggtgattcgccgctgcgcatccaaatcggcagcaacaatattcgcgcacacgtcggcgattttatcttcacatccaagctggttgatggccgtttcccggattatcgccgcgtattgccgaagaacccggacaagcatcttgaagcaggctgcgacatcctgaagcaggcctttgcccgcgcggcgatcctctccaacgagaaattccgcggtgtacgtctttatgtgagccagaaccagatcaaaatcaccgccaataaccctgagcaggaagaggcggaagagatcctcgacgtcacttacggcggcacggatatggaaatcggctttaacgtcagttacgtgctggatgtgctgaacgcgctgaagtgcgaaaacgtccgcattatgctgacggattcggtttccagcgtgcagattgaagatgcagccagccaaagcgcggcctacgttgtcatgccaatgagattgtaatgtcgctcacccgcttgttgatccgcgactttcgcaacatcgagagcgcggatctcgctttatcccccggctttaacttcctggttggcgcgaacggcagcggcaaaaccagcgtgctggaggcgatctacaccctcggtcatggccgggcgtttcgcagtctgcaaattggccgcgtcattcgccatgagcaggagtcgtttattctgcacgggcgtctgcagggcgaggagcgcgaaaccttaatcggcctgaccaaagacaagctcggcgatagcacagtgcgtatcgacggcaccgacggccacaaagtcgctgagctggcgctgctgatgccgatgcaactgattacgcccgaggggtttactttactcaacggcggccccaaatacagaagagcattcatcgactggggatgctttcacaatgaagccggattctttaacgcctggagcaacctgaagcgtctgctgaaacaacgcaacgccgcgctgcgccaggtgagtcactatgcgcagttgcgcccgtgggataaggagttgatcccgctggcggaacaaatcagtcaatggcgcgccgaatacagcgccgccatcgctgaagatatggcggatacctgcaaacagtttctacccgaattcaccctgagcttctctttccagcgcggctgggaaaaagagaccgactatggcgaggtgctggagcgtagcttcgagcgcgatcgcatgctgacctacaccgcgcacggcccgcacaaggcggatttccgcattcgtgccgacggcgcgccggtggaagatacgctctcacgcgggcagttaaaactgctgatgtgtgcgttgcgtctggcgcagggcgagttcttaacccgtgaaagcgggcgacgctgtttatacctgatagatgattttgcctcagagcttgatgacgcacggcgcggactgcttgccagccgcttaaaagccacgcagtcacaggtctttgtcagcgccatcagcgctgaacacgttctggacatgtcggacaaaaattcgaagatgttcaccgtggaaaagggtaaaataacggattaacccaagactaaatgagcgagaaacgttgatgtcgaattcttatgactcctccagtatcaaagtcctcaaagggctggatgcggtgcgtaagcgcccgggtatgtatatcggcgatacggatgacggcaccggcctgcaccatatggtattcgaggttgtggataacgctatcgacgaagcgctcgcgggtcactgtaaagatattgtggtgacgatccacgccgataactctgtctccgtaacggacgatggccgtggcatcccgaccggtattcacccggaagagggcgtgtcggcggcggaagttatcatgaccgtactgcacgcaggcggtaaatttgatgataactcctataaagtgtccggtggtctgcacggtgtgggcgtatcagtggttaacgccctgtcgcaaaaactggagctgctgatccgtcgtgaaggcaaaatccaccagcagacttacgtgcacggcgtgccgcaggcaccgctggccgtcaccggtgaaaccgacgctaccggtacgcaggtgcgtttctggccgagccatgaaaccttcaccaacgtcgttgaatttgaatatgacatcctggccaagcgtctgcgcgagctgtcgttcctgaactccggcgtctccattcgcctgatcgacaagcgtgacggtaaagaagaccacttccattatgaaggcggcatcaaggcgtttgttgaatacctcaacaaaaacaaaacgccgatccaccctaatgtcttctatttctccaccgaaaaagatggtatcggcgttgaagtggcattgcagtggaacgatggtttccaggaaaacatctactgctttactaacaacatcccgcagcgggatggcggtacgcacctggctggcttccgtgcggcaatgacccgtaccctgaacgcctacatggacaaagaaggctacagcaaaaaagcgaaagtcagcgccaccggcgacgatgcgcgtgaaggcctgattgctgtggtatcggtgaaagtgccggatccgaaattctcctcccagaccaaagacaaactggtttcttccgaggtgaaatcggcggttgagcagcagatgaacgaactgctgtcagaatacctgctggaaaacccgaacgacgcgaaaatcgtcgtcggtaaaatcattgatgcggcgcgcgcccgtgaggctgcccgtcgcgcccgtgaaatgacccgtcgtaaaggcgcgctggatctggccggtctgccgggcaaactggcggattgccaggagcgcgacccggctcactccgaactgtacctggtggaaggggactctgcgggcggctctgccaagcagggacgtaaccgtaagaaccaggcgatcctgccgctgaagggtaaaatccttaacgttgagaaagcgcgtttcgacaagatgctcgcctcgcaggaagtggcaacgcttatcaccgctctcggctgcggcattggccgtgacgagtacaacccggacaaactgcgctatcacagcatcatcatcatgaccgatgcggacgtcgatggctcgcacatccgtacgctgctgttgaccttcttctaccgtcagatgccggaaatcgttgagcgcggccacgtctacattgcgcagccgccgctgtacaaagtgaagaaaggcaagcaggaacagtacatcaaagacgacgaagcgatggatcagtatcagatcgctatcgctctcgacggcgccacgctgcacaccaacgccagcgctccggctctggctggcgagccgctggaaaaactggtggctgaattcaacggcgcgcagaaaatgattggccgcatggagcgtcgctacccgcgcgcgctgctgaaagagctgatctatcagccgacgctgacggaagacgatctcaccgacgaagcgaaagtgacgggctgggtgacgcagcttatcaacacgctcaatgaaaacgaaatgcacggcagcacctggaacgtcgcggtgcgcgagaacgccgagctgaaactgttcgagccggtcgtgcgcgtacgtactcacggtgtggataccgattatccgctggagcaggagttcattgtcggtggcgaataccgccgtctgtgcgcgctgggtgagaaactgcgcggtctgatcgaagaagacgcctttatcgagcgtggcgaacgtcgccagccggtggccagcttcgagcaggcgctggactggctggtgaaagagtcccgtcgtggtctgtctatccagcgttataaagggctgggcgagatgaacccggagcagctgtgggaaaccaccatggatccggacagccgccgtatgctgcgcgtcacggtgaaagatgctattgccgccgatcagctgttcacgaccttaatgggcgacgccgttgaaccgcgccgcgcctttatcgaagagaacgccctgaaagccgcgaacatcgatatctaagccgtttgtcccaggtggcgcgttgcttaccggggctacagcagcatcaggcccggtaagcgtcagcgccaccgggcttttttttggccgcaaaaggaggatcctctccccggactccatccccctttcttaccgtgttttttcggcagaatcgcgttagcatgcgttaagactcatttactgcggggaactcatggctatcaaactcattgcaatcgacatggacggtacattgctgctgccggaccataccatttcacctgcggttaaaaatgccattgccgcggcgcgtgaaaagggcgttaacgttgtgctgaccaccgggcgtccttatgccggggtacacaactacctgagagagctgcacatggataagccgggtgattactgcatcacctacaacggcgcgctggtgcagaaagcgagcgatggcagcacagtggcgcagaccaccctgagctacgacgattaccgctatctggaacagctgtcccgcgaagtgggctcacacttccacgcgctggatcgcaatacgctctacaccgccaaccgtgacatcagctactacacggtgcacgaatcctacgtggccaccatcccgctggtgttctgcgaagcggaaaaaatggacccggcgatccagttgctgaaagtgatgatgatcgacgagccggccattctggataaagccattgcgcgtattccggcagaagtgaaagagaaatacaccgtgctgaaaagtgcgccgtacttcctcgaaatcctcgataaacgcgtcaataaaggcaccggtgtgaaatcgctggccgatacgctgggcattacgcctgacgagatcatgaccctcggcgatcaggaaaacgacatcgcgatgatcgaatacgccggtcttggcgtggcaatggataacgccattgattcggtgaaagaggtcgcggatttcgtcaccaaatccaatctggaagacggcgtcgcttacgctatcgaaaaattcgtcctgaactgatcggcctgaagacgcaaaacgacatgaaacagatcacctttgccgcacaacaccatcagctgaccaatacccggacctggacgccggacagccagtggctggtctacgacgtgcggccttcgggcgcctcttttaccgggcgcaccattgagcgcgtcaatatacacaccggtgcggttgaggtgatttataccgcccctgagggggcgcatgtcggcgtggtgacggtgcatccggcggcggaaaaatatgtctttatccatgggccggaaaaccccgacgcagagtggcagtacgattttcaccaccggcgcggcgtggtgacgcatgcgggtaacacccaaaatctggacgcgatggacatcaccgcgcccttcaccccgggcgcgctgcgcggcggcagccatgttcacgtttatagcccgaacggtgagtacgtcagctttacctataacgatcatgtcatacatacgctctccccggcgctggatttgcgcaacgttggcgtggcagcgccctttggtccggtggaaccgccgcgcacgcatccgcgggaatactgcggcagccactggtgcgtgctggtcagtaaaacaaccgccacaccgcagcccggcagcgatgacatcaaccgggcttatgaagaaggctgggtggggaacgacgcgctggcgtttatcggcgatacgctgtcccttcgcggggagaaggtgccggagctgtttatcgtcaccttgccgcgcacagaggcggcctggaagcaggcgggcgatcgacctttagccggaacgcccgatacgctgcccgcgccgcccgcaggcgtactgcaaaaacgtctgacctttactcatgaacgggctttcccgggactggtgaacactccgcgccactgggtgcgcagcaatccgcaggcaacttccattgcgtttctgatgcgtgatgagcggggtattgttcagttatggctgatatcgccggagggcggggaaccgcgccagctgacgcacaatgccagtgatattcagtcggcgtttaactggcatccggcaggtaatgcgctgggctttgtgctggaaaaccgcatcgcgatgtgcgacgcgcaatgcggcgacatcacttttttgactaccgatcacgaaaatatcccggccgcagacgcggtggtcttttcgccggacgggcggcatatcgcctggatggaggagacgcagggataccgtcaactgtggttaacggccaccggattgtaaatcagggcgcgacggcgggcgggatcaccgaattggtcgccagattcgcctgctcgcttttctcgacgcgcgagcgaagtgaattatctttgcggaataaatcccagggcagcagcagcgtatccatcaccgccgtaaaaggcatatccagcgccaccagcgatttcatgccgatgctggtgtcatcgtcgccgagcatttttgtgctggcgctggtgccggggtaaagcccctctttgccgccggtatgggacatcacgctggagcaaccgccgatcgacatcatcccgcttacgacagccagtattagaagaatgtttttcataacgatttgatcatagtgagtggccgtacacgcttatagcgatcctgaacgtaaaagagtagtgatggagcgccacactgtggcggtcatcgcaatttaacaatttatgctgtaacccagtctatgcaatgactgcgaaagtgcaaaaaaaagtcagataaacacccttgaaaagaaaatgactgcacccattttaggtaatgtcccggaaagaacacgcctgcggggtgttcgggggccgacaagcctgtccatggtggaaggctgaaaattctcgctgatttcaggagcttatttatgcgtaacttcgatctttctccgctttaccgttctgctattggtttcgatcgcctgttcaacctgttagaaaataatcagacccaaagcaacggcggttaccctccgtataacgttgaactggttgacgaaaatcactaccgcatcgccattgccgtcgccggctttgcagaaagcgagctggagatcaccgctcaggacaatatgctggtggtgaaaggcgctcatgccgctgagcaaaaagagcgtacttatctctatcagggcatcgccgaacgcaatttcgagcgtaaattccagttagccgaaaatatccacgtacgtggcgctaacctggttaacggcctgctgtatatcgatctggaacgtgtcattccggaagcgaacaaaccgcgccgtatcgaaatcaactaattgccagggcacgcccgggcgtgcccgaatcaccttgctcgccgtcagggagcaaatgcctgtcttcatacaggcagatatttactcgcttctcagaaggagaaaaccatgcgtaactacgatttatccccacttctgcgtcaatggatcggttttgacaaactggctaatgcgctgcaaaacacggctgaagggcagtctttcccgccgtacaacatcgaaaaaagcgacgataaccactaccgcatcacgctggcgctggccggtttccgtcaggacgatttagagatccagcttgaaggtcagcgtctgaccattaaaggcacgccggaaaaaccggccagcgagccgaaatggctgcatcagggtctggtcatccagccgttcagcctgggcttcaccctggccgaacatatggaagtggctaacgcgaccttcaacaacggcctgttgcacatcgatctgacccgcaacgtgccggaagccatcgcgccgcagcgtatcgccatcagcgaacgccctgcgctgaacagctaagtctttatcacctctgatcttctggccgggccagcgccatgctgacccggcctgcttgtttctgcttactcccttttgtgcgccaccacccatacagccgcgctgcgctctgcgaaaatccctgtaaataatagtgttattcacaaggatccctttatgagtgagatagcgttaacggtcagtattctggcgctggttgctgtcgtgggtttgtggatcggcaatatcaaaatccgcggtgtgggctttggtattggcggcgtgctgtttggcggcattatcgtcgggcacttcgtcgatcaggccgggattggcctcagcagcgacatgctgcacgtgatgcaggagttcggcctgatcctgttcgtttacaccatcggcattcaggtcgggccgggttttttcgcctcgctgcgcgtatcaggattacgcctcaatctgttcgccgtgctgatcgtcattatgggcgggctggtcaccacgctgctgcataaactctttgctatccctttacccgtagtgctggggattttctccggcgcggtcaccaacacccctgcgctgggagcggggcagcaaattctgcgtgatttaggcacgccgggggatgtcgtcgatcagatgggtatgagctatgcgatggcctatccattcggcatctgcggcattctgctgaccatgtggctgatgcggcggctgttccgcgtcaatatcgaccaggaagcgcagcagcacgagcacagcgccgggaacggccatccgcagcttaaaaccattaatatccgcgtggaaaatccgaacctgaaccgcatggcgatccaggatgtgccggtgctcaacagcgacaggatcatctgctcccgcctgaaacgcgatgacaccctgatggtgccgtcgccgtccacaatcatcaggcacggcgatctgctgcatctggtgggtcaggaagcggatctgcgcagcgcgctggtggtcatcggtcaggaggtggatacctcgctgtccacacgcggcaccgatctgcacgtcgagcgcgtggtggtgaccaacgaaaaagtgctcggcaaaaaaatccgcgatctgcaccttaaacagcgctacgacgtggtgatctcgcgccttaatcgcgccggggtggagctggtggcgagcagccacgccagcctgcaatttggcgatattctcaacctggtggggcggcaagcgtctattgacgcggtggccgccgaagtgggaaacgcgcagcaaaaactccagcaggtgcagatgctgccggtgtttatcggcatcgggcttggcgtattgttaggctctctgccgctgtatgtgccgggatttccggtggcgttaaagcttgggctggcaggcggaccgctgattatggcgctcattctcgggcgaatcggcagtatcggtaagctgtactggtttatgccgcccggcgccaacctcgcgctgcgcgaactgggtattgtgctctttctggcggtggtcggcttaaaatccggcggcgattttatcgacacgctgatcaatggcgacggccttaactggatgggctacggcatccttattaccgccgtgccgctgatcgccgtcggcctgctggcgcgtatcttcaccaaaatgaactacctgacgctgtgcggcatgctggccggttcaatgaccgatcccccggcgctggccttcgccagtggtctgcacgccaccagcggcgcggcggcgctctcctatgccaccgtctacccgctggtgatgtttctgcgcatcatcaccccgcagctgctggcggtactgttctgggggataggttaagcgtcagcggccacgccgcaggtggtaatccacctgataatcgctggcattgcggtacatgatggaataattaagaaacacgccgctgtcgctgtaggacagcgacgtgatccgcaataacggcgtatcgcgagctaccttcagtagtctcgacatctccccgtccgccagcaccggcgtcaggctctcataattcccgctaatatctatcccgcagtttttttcgatgtagtcgaatttcgatccctccagatgcaccagcgccaggtcgtgaaacagcttcaccggcatatagctgtcttccagcagcaacggcgcgccatccacatagcgtaaccggcgtgaatagtagatgcgttcattgatttgcagacgtagctgactggcaatcgcgggtggggcgggcatcacttcgaattcaagcacctcgctcatcacgctgcgcccctgcgctttcataatttcgcaaaagccggtgagattgcgggtttcgtggtgcacatcttttttcagcagacgggtgccgctgccgtgccgccgttcaatcagcccctgttcgacaagtacagccagcgctctgcgcatggtcatgcgcgacacgccatactcctgcgccagcgttttctcgccgggcagcacgcttcccgtctgcatctctttttcattcagccgggcacgtaatgtttccgccagcgatttatagatcacttttagacctcttttttgtcattttcattccctgcccgtcagtcaccaggcgtccctgttctgctatcactaccgcattatttatgacatgtctgcttatttccgaaaatatagacaggtgcaccgaaataaaatcctgtgcagcatcacaaaataattatttattaaataagcgccgtgtctgccctgctttatgattattgcagttatccattatcagcccttccggaagttatatgcaatatttataaggattatgaaaatgctgagtcaaatacaacgctttggtggcgctatgttcaccccggtattgctatttccatttgcagggatcgtcgtcggtttagcaatattattgcagaatccgctttttgtaggcgaagcattaacatcgcctgattcactctttgcacaagtgattaatatcattgaagaaggtggctggacagtattcagaaatatgccgttggtttttgctgtgggattacctgttggcctcgcaaataaagcgcaggcgcgggcgtgtttagccgtactgattagctttatgacatggaattattttattaatgccatgggtgtagcctggggcgcttttttcggcgttgactttagtattgatgctgttgccggaagcggtttaaccactattgccggaattaaaacgctggataccagtattattggcggaattgtcattgccggtattgtaacggcgatacataaccgctatttcgataaacccatgccagtatttttaggtgtttttcagggcacctctttcgtggttatcctggcgtttttaatgatgctgccctgcgcatggttaacactctggggctggccgaaagtgcagtttgggattgaatcattgcaggcttttttacgcagcgccggggcggcgggcgtctgggtgtataccttcctggaacgcattctgatcccaaccggattacaccattttatttacggcccctttatgttcggcccggcggcggtagaaggcggtattcaggtgtactgggccaaccatttgctggaattcagccagaccactacgccgctgaaaacgctctttccggaaggcggattcggcttattcggtaattcaaaggtgttcgcctcgcctgggattgcgctggcgatctactacaccgccgccgtacataatcgcaaaaaaatcgccggtctgctgatcccggcagtattaacggcggtgctggtgggcatcaccgaacccctggaattcacttttctgtttatctcgccggtgcttttcgccatccatgcggtgctggcggcgaccatggcgacgttgatgtatatgggcggcgtggtgggaaacctgggcggcggcttccttgacaccatgctgccccagaactggatcccgatgtttaacaatcatgccccgatgatattcacgcagctcggcatcgggttgagttttaccgcgatctactttgtggtgtttcgcacgctgattttgcgcttcaacctgaaaacgccgggacgcgacgacgcggaaattaagctgtacagcaaagcggattacaaagcgttgcaggcgcaaaccccgacggcagagaaaaatccggccgcggcttacctcgcggccctcggcggcgcgggcaatattgcaacgcttaacaactgcgccacgcgtctgcgcatcacgctggtcgacatggcgaaaacgcacagcgacgacgttttcaaagccctcggcgcgcacggcgtggtgcgcagcggcaacggtattcaggtgatcatcggtctgcacgttccccagttgcgcgatcagctggaaagcctgatgagagtccctttatcaaaccaaccttcccccatgacagaggtcatatcatgaaaaaattctcggttgttattgccggcggcggcagcacctttacgccaggtatcgtgttgatgttactcgctaatcaacatcgcctgccgttacgggcgctgaagttttatgacaacgacggcgcgcggcaggaggtgattgccgaagcctgcaaaatcattctgcgcgagcaagccccggacatcgatttttgctacaccaccgatccgcaaaccgcgttcagcgacgtcgattttgtgatggcgcatatccgcgtgggcaaatacccgatgcgcgaaaaagacgagaagatcccgctgcgccacggcgtggtcggtcaggaaacctgcgggccgggcggtattgcctacggaatgcgctccattggcggcgtgctggagctggtggattatatgcagacctggtcgccggacgcctggatgctgaactactccaatccggcggcgattgtcgcggaagccacgcggcggctgcgcccgacggcgaaaatccttaacatttgcgatatgccgattggcatcgaaggacgcatggcccaaatcctcggcctacaagaccgcaaacagatgatcacccgctattacgggctgaaccacttcggctggtggcatgggatagaggacctggacggtaacgatttaatgcccgcgctgcgccagtacgtgtctgaacacgggtatattcctccgtcaaatgacgagcatacggaagcgagctggaacgacaccttcgccaaagcgaaggacgtgcaggcgctggatccggctacgctgcccaacacctatctgaaatattatctcttcccggattatgtcgtcgcgcacgctaaccccgggcgcacacgggcaaacgaggtgatggatcaccgtgaaaagcacgtgttcagcgcctgtcgcgccattattgaggccgggcattccgcagccggggagctggaaattgacgaacacgcctcttatatcgtcgacctggccgccgccatcgcctttaacacccaagagcgcatgctgctgatcgtgccgaacaacggcgctatcgccaatttcgatgccgacgcgatggtggagatcccctgtctggtgggcaaaaacggtccggagccgctgacggtcggcactatcccgcatttccagaaagggctgatgagccagcaggtggcggtggaaaaactggtggtcgatgcctgggagcaggggtcatatctgaaactgtggcaggccatcacgctctcaaaaactgtaccgagcgcctctgtcgccagagcgatccttgatgacttaatcgaagccaataaagactactggccgcgattaagttgatcctgccgggccggtattgttctgatgccggcccgactgcgcaagcgcctgcgatggcgcatagccaaagcgctgcttaaacgccttactgaagtgaaaagaatcaaagaaattaagcatatccgccaccctgctgacgctgtttccctgctgttttaacagcgacagcgccagatccagacgcgcatgcagtgcgtactcttttggcgttttgccggtataacgcagaaacaggcggcgcagataaggcgcgctgcactgcatgcgctgcgccatttcattcaccgtccagcgctgttgcggcgccgcatgcagagcggtgatcagtttttcaaattgcacttgctgtgcgtctttggtgcccttttcggcgatcagacaaatccactgatatatcatcttggtcagaaatgccaccgccagattatttttcattgcatcgccactgcgtgttaataaagcgacttcattaagctcgtgattaaatagctcgccattacagataacgccttgctgtaataatggtatttccattaaggtggtgggaataaactccatccagtattgctcccacagcaatcccgcacagtgataagattttatatccgtcggttttaaaaatataacgcaattgccgttaagaataatttcagcgtcgtcgcgcaaaatgatttttccgcagccctgcaacgtataaaccgccacccatgaattggcgatcaacggctttttcttatcgcgcggccagtaaacgcggtagctttcatcggcgagggtatgccataaggcgatcagtgaaataccgctggagatcacactttcatcaagaaccaacggaatattgtacgtgggttcgttttttacatgcgagttttgcaattttccattcattttaaattcccgccgcagaatgatgtccacaacctgaacgtaccagaaaataaatcgctcggggatctgaagtttgtattttaagaaatctgactgcctgacccggctcgccgggacataatgaaaataaggctacgagatgaatacgctacaaattctgagctttgtcggttttacgctactggtcgcagtaataacctggtggaaggttcgcaaaaccgacaccggctcgcaacagggttattttcttgccgggcgatcgctgaaagcgccggtgatcgccgcgtcgctgatgctgaccaatctctccaccgaacagctggtaggcctgtccgggcaggcataccggagcggcatgtcggtgatgggctgggaagtgacttccgccgtgaccctaatcttcctcgcgctgatattcctcccgcgttatttgcagcgcggcattgccaccattcccgattttctggaagagcgctacgataaaacgacgcgcattattatcgatttctgttttctgattgctaccggcgtctgcttcctgccggtcgtgctctattccggcgcactggcgctgaacagtctgtttcatgtcggcgactcgctgggtatttcgcagggtgcggcaatctggctgctggttattttacttgggctggcgggtattgtttatgcggtgatcggcgggctgcgcgcgatggcggttgccgattcgataaacggtattggtctggtcattggcggtctgctggtgcctgtttttggcctgatggcgatggggcacggcagttttctgcgtggcgttgaacagctcaccacccttcatgcagaaaagttaaactcgataggcggggcgtccgatccgctgccgattggcgcggcattcactggcctcatcctggtgaacaccttttactggtgtaccaatcagggcattgtgcagcgcacgctggcgtcgaaaagtctcgccgaagggcaaaaaggcgcgctgttaacggcggtgctgaaaatgctcgatccgctggtgctggtattgccgggcctcatcgcttttcacctctatcaggatttacctaaagcagatctggcctatccgacactggtgaacaatgtgcttcccgtaccgctggtgggattctttggcgccgttttattcggcgcggtgatcagcacctttaatggctttttaaacagcgccagcaccttattcagtatgggaatttatcgccggatcattaatcaggacgccacgcctgagcggttagtgcatatcgggcgaaaattcggactcgttatcgccattatttccgtgctggtcgcaccctggatcgcccatgcgccggaaggcttatacagctggatgaagcagctcaacggcatctataacgtcccgctggtgacgatcatcattatgggctttttctttccgcgtattccggcgctggccgcgaaggtggcgatggggctggggatcgtcagctatatcaccatcaactatctggtgaagtttgatttccacttcctgtatgtcctcgcctgtacgttctgcatcaacgtggtggtgatgctggtcatcggcatcattaaaccgcgcgccacgccatttcagtttcaggacgccttcgcggtggatatgcagccgtggaaaaacgcccggattgcctccgtcggcatactgttcgcgatgatcggcgtctattccggcctcgcgcagtttggcggctatcacacccagtggctgatgatcatcagctatgccattaccgccgccgtggttatctggttgatttacagcacgatgacaacggctaaaggtgcctctggcgctaaggataacgcatgaaccgccccaactttttgttcattatgaccgatacccaggccaccaatatggtgggctgctacagcggcaagccattgaatacgaataatattgatcggctggcagaggaggggatccgctttaactcagcctatacctgtgcgcccgtctgtacgcccgcccgtgccggtctgtttaccggcatctattccagccagtccgggccgtggaccaacaacctcgcgccgggcaacaacatcgccaccatgggacgctactttaaagaggcgggctaccacacctgctacatcggcaaatggcatctcgacggacacgactatttcggcaccggcatctgcccgccggaatgggatgcagactactggtacgacggcgcaaattatctggcggaactgactgaccagcagatcggcctgtggcgcaacgggctgaacagtattgaggatctgcgggcgaacggtatcgatgaaacctttacctgggcgcaccgtatcagccatcgtgccgtcgattttttacgccagcctgtgcgtgacgagcagccgttcctgctggtggtttcctatgacgagccgcaccatccctttacctgtccggttgagtatctggaaaagtatcaggacttttattacgagctgggcgacaaggcgcatgacacgctggaagacaaacctgaacatcaccgcctctgggcgcaggccatgccgtcgccagtgggaagcgatggccgctatcatcatccgctctattttgcctgtaatgattttgtcgacgaccagattggccgggtgatcgatgcgctcaccccacagcagcggcaaaatacctgggtgatttatacctccgatcacggcgagatgatgggcgcacatcagctcatcagcaaaggggcggcgatgtatgacgacatcacccgcatcccgctgattatgcgcccgccgcagggtacgccgcaccatgtcgatacgccggtcagccatattgatgtgctgccgaccatgatggcgctggcgggaataaacaagcccgccattctgcccggcgaaaacatcctcaacggcctatctgagcgtggcgtgatggtggagttcaaccgctatgaaattgaacatgacagctttggtggctttattccggtgcgctgttgggtgaccgatcgctacaaactggtgatcaatttatttaccagcgatgagctgtatgacagagcgaatgacgccagtgaaagggtgaatctgattaacgatccgcgctatgccgctgtccgcaatcagctgcatgatgcgctgctcgaatacatggacaccatccgcgatccgttccgcacatatcagtggcgacaacgcccgtggcgacaggatgcatcgccgcgctggatgggcgccttccgtccgcgtccggacgatggccattcgccggtggtgcgcgattacgacaccggtttgccaacccagggcgtgaaggtggaagagaaaaagcagaagttctgacgggttattgccgggtggcgcatacgcttacccggcctacaaagttataccgtaggccggataaggcgtttacgccgccatccggcacctttaatagtgccctacagcctgcacctcagctagaattggcgttcatccgtttaatcagggaaggagccgttatgaaaatttcccgcctcggcgaagcgccggattaccgcttctcgctggccaatgagcgtacctttctggcctggatccgtaccgcgctcgggtttttagcggcgggcgtcgggcttgaccagctcgcgccggattttgccacgccgctgatccgcgaactgctggcgctgctgttgtgcctgttcgcaggcgggctggcgatttatggatacctgcgctggctgcgcaatgagaaggcgatgcggctgaaagaagatctgccctatacccgtacgctgctggtaatcagcctcattctgacgcttgtcgccgccgtggtgatggtgctggtgttttatgccggatagccgcaaagctcgtcgccagcaggatcccggcctgcagccggagcgcacgtcccttgcctggtttcgcacgctgttgggctacggcgcgctgattgcgctggccatcagacatcactggtatgaatcagggataaccttctggatctcgctggcggtgctggcgctcaccgggctgatcctctggcgttacacccgcaggcgtaacctgatggatgtcagccacagcgactttgtgcaaccggcggcgttacgggataaattcttcattgcgctggcggtgctggcgctttccctgctgttcgcgagcgcgcatatccgccaggtattgttagtgatcgcagaatagttgtagcctgcctgtgctcacccctttaccacaccatttcatgcagggtttatcgtgactaaaaccgtgatcgccagcgcattactctttgttgccagcgccgcttatgccgcgccgccgctgacggctgcccgttacgccgcacagctggggccgggtatggaggtggactgggcgcgtactgaacgcggcatccgtgaattcgacccgctggtggtcagagattttgcggcgctgggtattcatcacgtgcgtattcgcgtggcgcagaacatgaccgaggcgcggctggtgcacctgcgtaaactggtggaggcgtgcgagcagtacggcgttatcccgatcatcgcgtatcaggccgacggcctgaaggccgatccgctgaaaaacgaggcggcgttagtggcgtggtggagtcgggtggcgcgctattttggtactgaccatccgctgcttggctttgatctgatcgatgaaccggcggaaaagctcaatcgcgatcaggcggcgctgagccggatttatgaccgactgatcaaaaccctgcatggcatcgacccccggcgcatgatttttgtcgcgccgcgcctgcggtcagcgccggaagcgctgactgagctgaagctgccgccgcacagccagaattacgtgctggcgcagtggcatatgccgggcgcagggccgcaaaaaaataacggtaaatactcaccgacgcctgccgggaaagccgccattcacgcgcacatcaatgcggtgctgcgctggcagcagaaaaccgggcacgtcagctgggtgggaagctgggcggtgggtgaagccagtaaaagcgcgccgacggccgcacagctcgccttcgccacctttacggcctgcgagctgaagcgggccaacattccttatgcaatcaatgccgacgcccggttttacgacggggaagagggcgcgtggcgtcctgaccccgcgccgctgttaaaaacgatgatcgccccggcgtgtgacgctaaaccgccgtttcatgatgggcaaagcgcgacgccagcggcagccagcacaacaggatcagcagccccatcagcgtcatcagcatcccgaggctagcctgcccgttctgcggcagcatggcggacagccaggccagcacgccggagccaatattttgcaggccgcccaccagcgctcccgccgtgcccgccagaaacggaaacggctccatcgcgccgctggtggcaagcgggaacagcatccccgcgccgaagaaaaacagcgccgccgggatcagcagcgtccagacgttcatcacgccaaaccagccggggatccacatcatcagcccggcgagcagacagcttgccaccgcctgccacatcagcgtggaaaagcgtttgttctgccgcccggcaaaccatgcgccgaaaaacgccgccgggatcggcagaataaacagaatgctcaccaccatactgctgaggcccagacccgcgccgagcagcacgccggaacaggcttcaaataccgcgatccccgcaaggccgccaatcagcatcagcagataacaggtaaatgacccgttgccgaacagcgttttgtagctggcgataagccgggtgcgcggcgcgtccaccggacgggtttccggcatccagcgcgccatgctcagggtaacgccgatgcacagcagcagtaaaaagccgaagcatgcccgccagtcccacagcgtattaagcagaccgccaatcaacggcgccagcagcgggctgaccagaatgcccatgttcagcagactgttcgcctggcgaagctgcgaaccggcataaagatcgcgcggcagggtgcgcgccatcacgccgccgacgccggtacccatgccctgtagagcgctggcaataatcagcaccgtcaggctgggggcggcgatcgccattaccgtggcgagcataaaaatggacatcccggcgaggatcaccggacggcggcccacccggtcggcaagcgggccataaaaaagttgtgagacgccgtaggtcagcaggtaggccgccatgacgctctgcaccgcgccttcccgcacgttaaacgccagcgccatatccgcaatcgccggtatatagatggtctgcgccatctggccgaccgccactaacaacaccagcatcattaacaaattaacgtttctgtcccgtttcatgtcgcgtaatactttatcagattgagaaaaaggagaataaaagcctggtcaggccgctgaatgcgagaggaatctaccacagcgcccggcggaagcaatcatgcatggcgtgaatgaaagaaggatgacagcgggaaaatgtaaagaatttgtggcaacaaatattgccagtttaactcaggcgagacgcagtaaaatggcccccagcgcgatgccgcaggcggcagcgatacgcatcccggaaactttctctttgagcagcacaaaggcgatgagcgcgccaaacaaaatcgaggtttcccgcagcgcggcgaccaccgccagcggagcctgggtcatcgcccacagcgccagaccgtaagagcccatggtgccgaggccgccaaaaatcccttttttccagtttgtacgcaggtagcgcgacgcctcccggcggcgggcgatcatcgcccagaccagcaggcaggcgccgttcatgaaaaaggtccacagcgtatagccaagcgcggtgccggataagcgcacgccggtgccgtccaccagcgtgtaaccggcaataaaacaggcgttgatcagcgccagcgcaatgcctttgcgcgaactggcgcgaccgttaaacgccatgccaagtatggcaaggcagatcaccgcgatgccgacccaggccatcgtcgacagatgctcgcccagcgccagtacgcttaccagcgccaccagcagcggggcagtgccgcgcatcagtgggtaggtctggctcatatcggaaacctgataggttttcgccaccagcacggtgtacaccacctgtaacacgcaggaaagggcgagatagggcgcgctggcccatgccggttgcggtgagaagggcagcagcactaaggcgatgagcgccgccgatccgctgacgctgatcgccgaaaaaagtttatcacttcccgccttaacaatggcgttccagctggcatgtaacagcgcggcaaacagcaaaatcaggaaaacggagagtgtcataacaggggcgaccggaggaaatgtaataaaaatgtaacacatattgcgcgggatgccagcaggctgtggttgaagcagaaggtgaaagaggggcggttgcccgcccctcttcggtgcggcttgaacctgaattaccggagtaatttcaggatggcatcaagcagttgcaacaacgcaacaatgagtttcaggatcagaactaccatatccactccgctcatacgcttctccttatggcgtaaggagtacgtccggctggcttacctttccgctgcctgtcaccagccgtttttcacacgctgtcgctccgttggcctgggggcaggcatggcgaaacgaggttgtgtgtgttggcgtatcacagtgtgcactcccggggttaaggcactgacggcaccacccgtttcagccaggactcattcgcgcccgacaaactagcagccccgtatcgcacactctgaaaacataaccagtatagaaaaagactgtatgcatgaacagtattttttggacgaaatgcgatctttgaccgatactcatattgcgcaaaattgcgcctgttgccgattcaacatatactgtgagagttgacgtagcacagtgtgttctgcggcccaccactccgcaaacgctcgataaaacctcatcgcacaaacctgttttgtgccaggggtttaaaagaataacggccctcatgcagggccgttttcttttgcgaagcgctaatcctcatccctgtcggtgtccttaccgtaccccagcgccaggctgtggctgggatcaaaaagcgacaaactttccacctgatcgagcaaaatcaccttacgaaaatgaaaggccgaatgcggctccgacgtcagggtaatattttgccgcgcatagagcgcgctgtagttattttcgatcttcatttccgcgcttttagcatcgcggtagccagtaagcatcgggatcagcacgatgttattgaaggaatcgccgtccaccgtggcggtatggatcataccgatgtacacgcgctgagatttcagcgtcagccacaccagctgcccggtttccatgcactgaaagagcaacccttcaatgccattagcccgcgacagatgcttatagagattctttctgccagcgctgtcgagattagcgctgcgcgcccagttcgaacggtacaggcaaaacagaatggcgaagaacagcatgatcactaccggggcctggatgccaagaaaggtccagttcataaaggtcatctgatagcggtgatcttcgctgccgaacagctccggcagggcgttcatcgataccgacgtcagcagcagtccgagccagacgatggccgtcgctatgatgccctgtaagacaaaaatgcagccgtacagcgccaccagaaaatagacatcccaaccgaaggtacggcggaatttcagacgtgtagacaggtcgcggctggtgtaccagtaaccgcacaccatcaacaccataaaaatagccgttcccatcctatacccttttcagtgcttcaacgtgccgggcaaaatcctcgaccactgccggacaattgatattcacgctggcgttgccgtcctcatcaatgatgatgcgctccccgtcctcaatcgattcctgcaccttgttgcggtcgataacgttaagaagcctctcggggctggtaaagagtttatgtagagcattaaacatacgctttctcttgtgactgtaatgaattaactgcttttaatagtagtcgtgatggctgatgatgaccgttgcaaaagtgtgggaaaacctttcagtgcgtgaatgagcagcgagatagggtacgttcatgtcgaaaaaaatggattttatcgacatgactgcgtgacatgtcgatggtatcaaggtggttcagaaaaattcataaacatacgaatattacattagcatgattttttaaaaggaaactatatagttattgccagtttttatgctggcaatattaatctcaaaattcatcaggcagtcgagcgttcgttccatgaatctgtatactggatattaccatcaacaatgcgccaggtaattttctcgtatcggagttgaacattttccaggtgtccagtcccagggcaatctctggtgtcatgcataaccggtgtaattgaaatgatcttcacatcttccataaaaatattaaaatattcgacctcttggcccgcatcgttaatattataaaactttaactcggcattttgtagcgtctgaccggtagcaacggctttgtaaagataaggcgatgatgaatcaatagctttcgtcagactaaatggtgaatgttggcgcgttcctgtcaacgcgcccgtagcagtatcgttgggaatacagaggttatgaatcagatctctaagttctatactgccttcgcgaccagcaacatctgaaccgccacgtatcattgccccgctatcgtctttcaaaaagaggtgaaccggtacagccattttaacgctccttgttagtctctggtaccattggcgacaagattaatgataggcatcactgcgatgccatctgtgtagaacaaatctgaattcgtgaaactgtaaacttttccggtaatttttatgtttaccgtattcccataagctgaggccgtaactgcgggagtgtttgtctcaaggaatggtgaacgttctcttaatttttccatgatgtcgatatttccttcatctttatcaagataaaaacgataaatatccgaaacggaggcgttcccctcatcgtattttgtgacatataaacagatactatctgataattttttcttacttataaaaatatcgtgaggtggagtattataaaaatattggcaagcgacgtagccactaacgagcattaataaaattactgtaagcacaccgtgcatggatctaataaccgatctttcttgcataatctattccttgttttacccaaaattgatcgcgtggatcgtcaccatatggcggcttgtgataccagtggccccattctttcctgttagtttttgctctttcctgcgcaaagccagcccccatgagtaaaattttttctgggattcctgccgcatagccagttgctccatagtgaaagttgccaaagttttctaattctggatgctgttgcttatagtcccatggtccgcgatttctgacttgcatgtagaaccaggtataagtgagaggagttgccatatcgcgagacataccgtgtgtacgcgctatgcgcatgttatttctaaccagcgatattccctgcgcagggagtaaaggtataacagccatgttaacctcttcttttataagctattaaaaatcatacctcccggacgctcgcttttaatatggcggtagtcacataaatcatttcaagggcgaccacactccattagccaggtggcagaaaatcgtgatcattcacgcattttcaccccccgccgcacaaaaccattgtcaccggcggcatcctgtgcttgtatgaatcctgttaaaaaatgaactgagaaccctaatgcacccatccatgctgacctcgaccctactaaataccgcgccattcgccgcggtggtcgtcgtgcgtgtggtggtggtcgtcggcatcgcgccgtagggtccggaacacacgattccaaaccccgccggcgcaaaccgggcggggttttttattgtgacctccccggaaagtcggcccagaagaacaggactggagcatggcaatttcggacacaacatcacagacaaagcgctttaccggcgcgcaattaatcgttcatttactggagcgccagggcatcaccatcgtgaccggcattcccggcggcaccgtgctgccgctgtatgacgcattaagccagagcacgcagatccgccatgtgctcgcccgtcatgagcagggcgccggttttatcgcccagggcatggcgcgtacccagggcaaaccggcggtgtgcatggcctgtagcgggccgggcgcgaccaacctggtcaccgccattgctgacgcgcgtctcgattcggttccactggtgtgcattaccggtcaggttccctcctcaatgattggcaccgatgccttccaggaagtggacacctacggcatctctatccccatcaccaagcacaactatctggtgcgtgacatccgcgaactgccccaggtgataagcgacgctttccgcatcgcgcagtctggccgtcccggcccggtgtggatagatattcccaaggatattcagaccactgaaatcgaactgagcgagctgcctgagccaggcggcgtggcggcagccccggcctttgaaccgcaaagcgtgcgtgatgccgcgaccatgattaaccgggcgcagcgcccggtgctctatctcggcggcggggtgatcaacgcgccggaggcggtacgcacgctggcggaaaaagctaatctgcccaccaccatgacgctgatggccctcggcatgctgccgaaagcgcacccgttatcgctggggatgctggggatgcacggcgcgcgcagcaccaactttattttgcaggaagcggatctgctgatcgtgctgggggcgcgttttgatgaccgggcgattggcaaagccgaacagttctgcccgaacgcgaaaattatccacgtggatatcgatcgtgcggagctgggcaaaatccgtcagccgcatatcgccattcagggagatgtcggcgaggttctggcggagctgatcccgcaaatcgaggcgcagccgcgcgcggcctggcgcgatctggtggcgcagctgcaacaggagtttccggcaaatatgccggggatggacgatccgctttcccattacggtattatccgcgcggcagcggcctgcgtggatgacagcgccattatcaccaccgacgtgggccagcatcagatgtggacggcgcaggcttacccgctgaaccgtccgcgtcagtggctgacttccggcggcctcggcaccatgggctttggtctgcccgccgccattggcgcggcgctggcgaacccggatcgcaaagtgctgtgcttctccggcgacggcagcctgatgatgaacattcaggagctggccaccgccgcggaaaataatctcgatgtgaaaatcattctgatgaataacgaagcgctggggctggtgcatcagcagcaaagcctgttctatcagcagggcgtgtttgccgccacctatccggggatggtgaactttatgcagatcgccgccggattcgggctctacagctgtgatttaaatggcgaagcggatccgcaggccgcgttgcaggcggcgatttcccgccctggcccggcgctgatccacgtgcgtatcgacgccgaacaaaaagtgtatccgatggtgccgccgggcgcggccaatactgagatggtgggagaataagccatgcaacattccgaacatgacaatgtgatccttgaactcaccgtccgtaaccatcccggcgtaatgacccacgtctgcggcctgttcgcccggcgcgcctttaacgtcgaaggcattctctgtctgccgctacagggcggcgagcagagccgcatctggctactggtcgccaacgatcagcgtcttgagcagatgataagtcagatcgacaagctggaagatgtggtgcaggtgatccgccatcagaccgatcccggcgtgttcaacaaactggggttgtttttcgagtaaaccgcgactcactcactcccgttgccgggagtgagcactttcacgaagccgttacggcaacggtcggggtaatccgccggtaacggcctgtcgctgatcagcacatcaaaagcggcgagcggcgcaatgttcgcctgcgccacctcatcaaaacgcgcatatcgcgcgagcaaaatcttgcgcagcccgcgctccatggctttgcgtttcatcggcagatcgtccgggttaaaccaggtgacgccgaactgcgcatgcacgccgctggccgaaataaacactttgcgtgggttgagtgaatcgagaaccgaggcattcaccggatcgtaaaacgcatcgcttttcgcccgataggtgccgccgcacagcatggcggtggtgttggggcgcgcgttaagcgccataaatacctgatgggaatagcaaataccggtaaaggcgatgtcgtcggggatcatgctgatgaccagcggcatttccgggccgttatcgaaaaacaccacatcgttctcgctcaccagtccggcggcaaggatcgccattggcacatcatcgcggtgatgcccggccaccggcgcggcaggctggctggcagacggggcggcgggcttattcaccatcacgatgtaaccccccagcagcgccagcggcagcggttcgtcatcctggctgaaatcgcgtcgaatcgtcatcagagaaacttccagcatacgcgccgcctccttcagatggatgcgatcggtctttttgagcagctccgtcagccgacgaattcgctctttctgcttggtttccattcactttctccgcaatacaggcctcaacgctgatgttcctaaagtaacattttccccggaaagcgggaataacggcgcgtaaaatgttcctgtaatcgcgagataagtcacaaatgatactaaaataacatgttaatgttacgataatatcattgttatgtgattgtttcagagaggtagtaaaaatggatattgcagtcatcggctccaacatggtggatttgatcacctacacccaccagatgccgaaagagggcgaaaccctcgaagcgccggcgtttaaaatcggctgcggcggcaaaggcgcaaaccaggcggtggcggcggcgaagctcaactcgaaagtgctgatgctgaccaaagtgggcgatgacatatttgccgacaacactatccgtaatctggaatcctggggcatcaacaccacttacgttgaaaaagtgccctgcaccagcagtggcgttgcaccgatttttgtcaatccgaattccagcaacagcattctgattattaagggcgcgaacaaattcctctcgccggaagatatcgaccgcgcggcggaggacctgaaaaaatgtaagctcatcgttttacagctcgaagtgcagctggaaacggtttatcacgctattgagtttggtaaaaaacacggcatcgaagtcttactgaatcccgccccggcattgcgtgaattagatatgtcctatgcctgcaaatgcgatttctttgtgccgaacgaaaccgaactggaaattctcaccggtatgccggttgatcaccttgataatatccggctggcggcccgcagcctgatcgacaaagggctgaacaatattattgtcaccatgggcgagaaaggcgcgctgtggatgacgcgggatagcgacgtgcatgttccggccatcaaagtgaatgcgattgataccagcggcgcaggcgatgcctttattggctgctttgcccactattacgtccagagcggtaatgtcgaagccgccatgagaaaagcctcgcgtttcgccgccttcagcgtaacgggcaaaggcacccagtcgtcttatcccagcattgagcaattcaatgagtttctggcgttaaacgaataataataaaccctgcaacgtaaaaggtagcactatgaacgataaaaacatcgttcagatgcccgacgggtatctgaataaaacccctctgttccagtttattttgttatcctgcctgttcccgttatggggatgcgctgctgcgttaaacgatatattaattacgcagtttaaaagcgtattttcattaagtaatttcgcctctgccttagtgcagagcgcgttttacggcgggtattttttaattgctattccggcttcgctggtcattaagaaaagcagttataagatggcgattttaatcggcctgacgctctatattgtcggctgtacgttatttttcccggcgtcgcacatggccacctacaccatgttcctcgctgcgatcttcgctatcgccatcggcttaagtttccttgaaaccgccgccaatacctacagctcaatgctcgggccaaaatcccacgctaccctgcgccttaacgtcagccagacgttctatccggttggcgcgatagcgggcattctgctcggcaaatatctggtgttttccgaaggcgacagcctggaaaaacagatggcgggcatgaacgccgcgcagatgcatgactttaaagtgctgatgctggaaaacactctcgaaccctataagtacatgatcatggtgctagtggtggtcatggtgctgtttatgctgacgcgcttcccgacctgcaaagtggcgcagaccacgaaacgccagcgcccgtcggcaatggacacgctgcgctatctggcgggtaacgcccgcttccgtcgcggcattatcgcgcagttcctttatgtcggtatgcaggtcgcggtgtggtcgttcactatccgtctggcgctggagttaggtgacatcaacgagcgcgatgcctctaactttatggtctacagcttcatctgcttctttatcggtaaatttgtcgccaacctcctgatgacccgcttcaacccggaaaaagtgctgatcctctattcggtgattggcgcgcttttcctggcctatgtggcgctcgcgccaaactttaccgcggtctacgtggcggtcgcggtgagcattctgttcggaccatgctgggcgaccatctatgccgggacgctggacacggtcgataacgagcacacggaaatggcgggtgcggtgatcgtgatggcgattgtcggcgcggcagtggtcccggcggtgcagggctatgcggcggacctgttccattcgctgcaactctccttcgtggtttccatgctgtgctttgtctatgtcggcatctatttctggcgtgaatcgaaagtggttaataaggaggctcctcatggcaacgcgactgacactgtggcgtgagttatttaccgcgcagccgaaaatcctgctggaaaacagcgacttcagtgtcaccgcttttcgttacgccagcggcgtggaagggctgaaagtggcgaacacgcgcgggcatctggtgatcctgccgtggctggggcagatgatctgggacgcggaatttgacggtcatgacctgaccatgaaaaacatgttccgccagccgaaaccggccaaagagatcgtcgatacctacggctgtttcgctttccactccgggctgctggcaaacggctgcccgtcgccggaagataatcacccgctgcacggtgaaatggcctgcgcggcgatggacgacgcctggctggagctggacggcgaggcactgcgtatcggcgggcgctacgagtatgtgatgggcttcgggcatcactacgaggcgcagccgtcggtcacgctgcatagcgccagtgcgctgttcgacatccatatggcggtgactaatctggcgtcggtggcgatgccgttgcagtacatgtgccatatgaattacgcctatgtaccccaggcggcgttcagccagaacctgccggatgaggcgctggcgctgcgggagtctgttccggcgcacgtgaagcccacagaacagtggctggcgtttaacgaacgcatcagacagggtgaggccacgctgacaacgttaagcgagccgcagttttacgatccggaaatcgtcttctttgccgataaactcgatcgctacaccgcggcgccggaattcaggatgaccgggccggatggcaccacctttgtcacccgcttttccagcgccgagttcaattatgtcacgcgctggatcttatataacggcgatcagcaggtggcggcctttgccctgccggcgacctgtcgtccggaaggatttctggcggcagagcgtaacggtagcctgctgatgctggcgccgcaggaaacccggcgtttcacggtcaccaccggcattacggcataaactgaggctgtacgtcgccgcgtttacccttatgataagcgctcgcaaaaggtgctggagctttcatgatttggttaacgctggcgacgctggtcgtcgtgtttgtcgtgggatttagggtattaacatcagattcccgtcgggcggtgcgccgtctgaatgaacggctcggcatcacgccggtgccggtggagtcgatgctggatcagatgggaaaagccgcagctgcggagtacattcagtatctggcgcgcccggatgaagcacatctgcaaaatgccgcgcaggtgctgctggtgtggcaggcatgtattgtcgatgccagcgagcaaaaccttcagtactggtaccgtctgctgaaaaaagcccgccttgccgccccgctgaccgatgctcaggtgcgtcaggcgctcggctttctgcgcgagctggagccggacgtggcggaaatcaataatttccaggtacgctataacgcgctctttatgccggacgacggcgtgcactggctgcactgatttttcccctctcccctggggcgagggaaaaccctgaatccgcactaaagttgctaaaacgttaaatacgtcacactcacaatgttacactgcgcaactttctcgccaataccgacgcaggggacgacatgagtgagcataaagaaggacagcagcgaccaaactggtcggcagtgtttgccgtcgcgttttgcgtggcctgcttaattacggtggaatttctgccggtcagcctgttaacgccgatggcgcaggacttaggcatttctgaaggcgtggccgggcagtccgtcacggtgacggcatttgtcgccatgtttgccagcctgtttattacccagactattcgcactatcgatcggcgctacgtggtgattttattctccgtgctgctgacgctctcgtgcctgctggtctcctttgccaacaacttcacgctgatgctgctgggtcgcgcctgtctgggcgtcgcgcttggcggcttctgggcgatgtccgcttcgctgaccatgcgactggtgccggcgcgcaccgtgccgaaagcgttgtcggtgatcttcggcgcggtgtccattgcgctggtgatcgcagccccgctgggcagcttcctcggcggcattattggctggcgtaacgtgtttaatgccgccgctgtgatgggcgtcatctgcacaatctgggtctggaaagcgctgccgtcgctgccgggcgaaccgatgcagcacaaacaggatatgttcggcattctgaaacgtcccggcgtgttcgcagggatgtgcgccattttcatggcttttgccgggcagttcgccttctttacctacatccgtccggtatatatgagcatggccggtttcgacgtggacggcctgacgctggtgctgctgagcttcggtatcgccagttttgtcggcacgtctatgtcatcgctgttcctgaaaagatcgctgaagctggcgctgacctgcgcgccgctgttgctggcggtcagtgcgctggtgctgatgctgtggggcagtaataagatcgtggccgccgctattgcgatggtgtggggcttaggttttgcgctggtgccggtgggctggtcgacgtggatcacccgttcgctttccgatcaggcagaaaaagccggatcacttcaggtggcggtgatccagcttgccaatacctgtggcgccgctgttggcggttatgccctcgataacctcggcctgctctcgccgctggttatctccggcagcctgatgctgttaacagcgctactggtggccgcgaaggttcgcgtaaaagaggtgcattgagggttaacggtcattatgcccggtggtggcttgcgccttacccggcttttacatctgtaggcccggcaagcctgcgccgccgggcaacccatactagaaccacgcttcccacatcgcgccgacgttgaacgaatccagggtttcatcatcggtattgttgatacgcgcggtgcgttcgttatccaccttgccgccggtcacgtagaagcgcagcatcggacggaattccggtcccatgtcgatggagatgttctgcgacagcgtggctttccagccgtggttatccccgccctggtcgaaatcaactttctgccagcccagttccagccaggtggaatgcacctggttccaccagtacatcggacgcacaatggcgttgtagttgcgacgatcgtcgatgttgttcgcatcgttcgaatagtcgtggtacgccagcaggtattcgacctgcgcctgttgggtaaacttgtagttaccttcaaagctggcgtagatcgccgtcagctcgtcggttttgttgtagacgctgttgtctgagttatcggagtagcgggcgatgactttattcacgccgctgtcgccggtgtggctcagcaccacgccgccctgccaggctttcagacgctcatcgctgtcgacggctttcgagtcaaagccatagttggcgtacagctccacgtcgatcggaccggctttgatgccgtgaactttcgaggtcaccgcatagttgcctttatcgccggtgccggagccgccggtacaggtgatacgcgacgggttgccttcgtcattcatcacttccgggctacaggattccacggctgccacggtcgccacgtcaaactgcacgccgccgatgtcgaagtttttgatccccgcgccctggccgtcatggttcatccagaagtagtcgttgatgccctgttgcggacgctgatggaagtcacgacccgcccagatataggcgttcgggttggactccagaatgttggtcaccccggcataggcttttttcaggttcacctcgtcgccccagtgatcgatcatcacattgatgtcccagatggcgccgttcgagcctttaaaggctttggaaagctggaattcgccgccgttgccttcgttacccaggcgaccaatcgccgaggagccgttataggagccatcgacgccgacaaatttctgatcgccgctctggaactgcgcgccgtaacgcgcatagccggtgaacttcacaccgaacgggatcgccatgtccggcgtctgggcggtgctttgcggttcggtgatgacgtcggctttcttcgcaatggccgcgtccattttcgcctggcgctccgccagggctttatccaccgctttagccacgatggcgtcgatctgttcctgagtaaattcctgtgccactacgtttcctgagcaaagcgcagccatgaccgccagcgccaccggaagttttttatttaatttcatgtttgtctcaatgtagtaaattattttcagacaataatcatcccgtccgtattaaacggaataattgtgctatcaccatgtcatattatttgtgggtacagatgtattaaaatattctcgtaacgatttctccgttatctgataaataaattaacgttgatacagctggacgatttcttcggataattcacgggccagtaatgacgtcattaaatgatcctgggcatgaaccataattaatgtcatcggctggcgggcttcgcctgcatcctgctcaatcagtttggtctgcatatggtgcgcctggcgcgaatagccgtcggcttcgcgcagcaggcttttggcttcgtcgatgttgcccgcgcgcgccgcgcgcagggcttcaaagcacaggctgcgggactgcccggcattgacgataatttccattaccgcttcttctaattcgatcatgataaagactcttcgttaaaaccattgttggctgaggtggcggcaaaccattccccgctttttttgacggtgcgcgtctgggttttcagatccagctggacaaaaccgtagcggtttttatagccgttacaccaggaccagttatcaataaaggtccacatgtgataaccaaggcaattacagccttcgctgatccctttatgcagccacttcaaatgcccggatacaaattcaatgcgataatcgtcattaattttaccgtcttctacaaagcgctgttcattttccacgcccatgccgttttcagaaataaagcagcgcgggttgccataattgacgcgtaaattggtgagaatgtcgtaaatacccggctcgtaaatttcccagccgcgatacggattcattttccgccctggcatctcgtaataatcaaacaaccactccggcataaacggtgactgcgggttaacggcgttttcacggcatttcacccgacgcggctggtaatagttaatgcccagcaggtcgatttttccttcggcgatcagcgcgccatcttccggcgtgcaggcgggcagctgatcgtactctttcagcagcgacaccagatcgggcggatattcgcctttcagcaccgggtcgaggaagctgcggttaaacagcagatccgcatggtgcgcggcggtgacatccgccggatgctgcgaacgcgggtacgacggcgtcaggttcagcacgatgccaatctccccggcgtagtgcccggcgcggaatgcgcgcaccgccgaggcatgggccagcacagtgtgataggccacggtggctgcgcgtttgaaatccaccacgttcgggtaatggaagtcatacagatagccgccttccaccggcacaatcggctcgttgaaggtaaaccagtgcatcacgcgatcgccgaacagctcaaagcagacctgcgcgtaacggctgaacgcctccaccacctcgcggttttcccagccgcctttctcctgcatcaccatcggcatatcgaagtggaacagggtgataaagggcgcaatgccctgcgccagcagctcgtcgatgacgttgttgtaaaacgccaccgcctgcggattcacctcgccggttccgtccgggatcagccgtgaccagctgatcgaggtgcggaaactgttgtgattcagctgtttcatcagcgcgatatcttcgcgccagtgctggtaaaacgtcgaggtatccgcagggcctacctgctgatgaaagcgccacggctggctggcgtaccagtgatcccatgtcgttgcgcttttaccgccgtgctggctttccccttcggtttgcagcgccgaactcgcgctgccccaccagaaatgcgcgggaaatgcgtatttcatctcaaccttctccttattcattacgggctgaccgtttccgccagcggactggtggcctgcgctttctgctcttcggttttcatcagcgagcgctcataggcacgcaggaacggcaggtacatcagcgccgacagcaccatacagatgaggcacatcaccaccggactcagcgcccagttggcggcccaggacgcgcctatcggtgccggtgtggtccacggcgtcagggagaccacctgtgccagccagccgagacgggtcgcgccatacgcgaggcaggcgttaaccatcggcacgaagacgaacgggatgaacagcatcgggttcatgatgattggcgcgccgaacaggatcggttcgttgatattaaagaagcttggcacgatgcccattttgccgatggtccgcaggtgcgtcgcacggctgcgcagcagcaggaacgccagcggtaaagtggagcccacgccgccaatcagcagatagtgatcccagaagccctgcagatacacgtgcggcagtgcagcgcccgcggccagcgcggcctggttggcagaaaggttcgccatccagaacgggttcatgatgccagtgacaatcagcgaaccgtggataccggcgaaccagaagatctggcacagcagcaccgacagcagaatggcgggcagagaatccgatgcggacaccagcggctccagcaggtgcataatcgcctgcggcaggatcatgccggtctgcgcttcaatgaacaggttcagcggatgcagggtggcgatcaccaccagtaccggaatgaggatctcaaacgagcgcgccacaccggtcggcacttctttcggcagacggatggtaatgttgttctgcttcagccacgcatacatgcgggtggaataaattgcggtgatcagcgcggtaaaaatcccctggccggacaggtactgcgtggagattttgccgtccgcataaggtgctgcgaccagcaaaaacgccataaaggccagcagaccggacatcaccggatcgagattaaactgccgcccgaggctggcgccgatgccgacggagataaaaaacgtcatcacgcccatgctcaggttaaacggcagcatcagctgttcgcggtaagtctgggaaaaatccagccagccacgggcaaagctgttggtggtatcggcggagaacggcgggaagataaacaccagcataaacgaaccgatgatcatgaacggcagcgcggcggtaaagccatcacggatagcgataacgtatttctgctgccccagtttgcccgccagcggggtgatggattgttcaatgacggcaaccattgactgatataacgaactcataggaacacctttttagtgcgccgcctcgatgagcgacagagcatagtccagtaccttatcaccgcgctgcataccgtaatccatcgggttgatgggctgaacgggtatgccgcaggtggcagccttttcggaaagcgtatttaacatatattttacttgtgggccgagtaacaccacctgatagcgcgagaactgcgtatcaaattccgccacgccgtaggcatcaatctccaccggcaaaccccgggtttgcgcctcttcgaccatttttctgaccagcagacttgtggacatgcccgcagaacaacacagcatgatcttgaccatcgacaaccatcctcaaaatgttaaaagttattgcggagctgattggataacaaacggaaaccggtttccattttttcgcggatgaattgtgaagcccgtcaatctctgtaatttataagcgttctttattagcgctgcatcacagattttgcggctattctgatagcaggaaagtgcgtttggaaaatcggtttccatgaaaaatggaaagcggttatactgcaactggcgatattatgagccattgtacgatttggaattttttggccctcgccgggcctcccaggggataaagatgtctacaatcaacgacgtatcacgtttagctggggtgtcaaaagccacagtttcacgggtgttgagtgggtcgcgaggggtcaaggaagccagccgccttgcggtgttaaaagcggttgatgaactgaattatcggccaaacgtcatcgcccagtctctgctgagccagtccacgggctgtatcggcgtgatttgcgcccaggataacgttaatcaaaccaccggttacctgtacgcccttgagaaacatctcagccagcatcagaaacatctgctgctgcgttttgccaacaacaaagcgggcgtgatgaacgcgctggaggagctgacctgcggcttgtgcgatgacgtgctgatcattggcgcacgttttccgctgggcaacatcgatgagagcgtgatcctcgtggattgcgccgaggcggaatccaccaacagcatccagtttgaccacgctttcgccgcagaaaccgcctgtaattacctgataagccagggccgacgccagatcgccgtcatccacccggataccagcggcgcggcggatcaggttttactgggttacaaacacgcgctggaaaacaatttcctgccgtttaatcgtaatctggtgtttatggattccaccagttcgtccgtcgccttacaggtcctgcttaacaacgcgaccacgctgaactttaacgcgctgctggtggccgacgagcaggaagcgcagcgggtgatcagtcagcttcaggcgtttaataaatcggtgccgggcgacattatggtattcagccttgccggttcgctgcaattaccgggcattccgagcattcccgctatcgagtattcgatggacgccatggccgcccgtattgtcagctggcttaccgaaaaaacgcaaagcgtactgggtgcctgcgtactgcgcggcgatttaattatcccggatcgcagaacgcgttaattactcatcgcctccgcaccctgcgggggcttttttgatagcgatcaccaaacgaaaatatatccttcctccgcttgccattacttaagaaatttaatttaaggcccgcaattttagattgcggttttgaatgaatgcgcaacacaatacgcgtcggtatctgtaagattacgtcatgctatgagcgatcatagtattggcggtagcgttccctggcacagccgatggcatacgaattggctcatagcgatagatatgtatcacgcatatttaataaataaaatttttaataatattgttgaacgtgaaaaaatgtttttttatttcctgagtacgggaggcagagtagagcctggcgtatattgaccattatgtcttttaaatctctgaaaaaacgccgcaatatcaggacacgctgaacagatccggcacaggcagtgattttcagcgggggatccaggcggcgacagcagatgccgtgtccggtgaactgcagcaaaagtgattgccgcacggttgtatccgcatgcgaaagagatgtctgatctgaacgaagaggaaaaacagacggtcagcatgctggcgacgatgtcggcaggcctggcgggtggccttgccggtgacagtaccgtatcggcaggtacaggtgcacaggcagggaagaatgcggttgagaataatttactgggaggtaatgaagatgctcaagctgcatggatacgtgagcatgggatcgatatggcgacctgttctgataacccaacggtgcaagcatgccagaaggctaaaaatgaacgagatgcggtaggattggctttggcaacaggtactgtggctttgcttcctggtagtgctcaggtgatgtggggacttggtgctggcgctaatgcaggggttaattactgggtagatggcgcaattgacccagctaatgcggctattgcaggttgggtgaatgtgttcagcatgggtaatggcctaacgggtagcatgggctggaatgcggcaggtggtacgttgggtaactggattgacagcaaagatccgctgttaggtgcgcttattaatggtgccggttcgggtgttggttatggcattggtaaaggactttcatggggcgttaatgccggagcaaactggtggaaaggttgctgggatcctaagtttaatgctgacctgagacagtttactgaagtgaaggggaaactggggctttcaaaagaaatgacacctagtaattttccaggcatggctggcgatatcggtggtagcctgggctctgagctcagtgggaagtatatagagcagaaatcatctcaggaggagcgcaaaaaatgagaaagaaaaatacgtttctacacctggctctttttatcgcattaagtattatttctatttttttgacatcgattactttatacgtagtaggggagttattattcttctttttcagagaaataccaatgaatttcactatggaaaatatatttctgctctgtaaaattagtcttagcgtcggaagttttgtcgggggcggattgtggatagctcggttattgaaattaaaaggcttctaagtttttgctgagaataatttattgggtgggaatgaggagacccagaccagcttcgtgcaggaacatggaaaaaatatagcgtcctgttcaagcaatcctggcagtgttgcctgccagaaagggctggcgatgaataatgcgttgatggtggcacttcctgcgggtcttggtggtggcatccaggcggcgacagcggggctacaggggctggcgggtggcaatatcgcgggtgcgctggcgggcgcatcggctcctgagctggcgcatattatcggacatgaatccgggctgagcagcgatgccgcccttgtagcgcatgcgatcctcggtggtgtggcggctacgttgcagggaaacagtgcagcggcaggcgcagcgggtgccgtgtccggtgagctggcagcaaaagcgattgccgcacggttgtatccgcatgcgaaagagatgtctgacctgaccgaagaggaaaaacagacggtcagcatgctggcgacgatgtcagcaggcctggcgggtggccttgccggtgacagtagggtatcggcaggcacaggtgcgctggcagggaagaatgcggttgagaataatacatttagtttgccaaacgggataatgaactacggccaggcagtagcttcctggaatcagttcgcggtaaacaataacctgacacaggaagaaacccaggccggggtggataagatcgcaaaaggcgatatgccagacagcaccaatatcgctaaagtaatggtggatggctcctcgaatatggcttttgcttttgcagcatgggaactggggctagcggcctcagttggtaaagccgtggttggtggggttacttccactgctgtgaacggtggttttcaatggtatggcttaaaccagcctggtagtgaagatcagtcatgggattataaaggcagtgcatcctcattcattacagggatgcttgctccgggacgcaaagttacgattaatacagctatagcgctggggggatcggtatttagcgatggtgctaatattaagtctcaagccggaacagccctgggggcatatgcaggtggatatgtaggagaatacttccctgtgatattgaggccggttttagggagctctgcaactgctgtcggtgatattagcggtggttttgtttctgagttaattaactacggtattaaaaataatcccactccaactagtaaggaaccggaacatgagtaaaaaaccttcagtatttttattatttttaacaataatatattgttgggtgatcttttttttaatcggtagcgtagtgctgctcattatgaatttatggaaagggaatggcttctatttttcacaacaacaagttaaagccgccatcatattgagtgggatagcagggtgcggcgttggattaagaacatggatctttgcattgattgataaacgtaaatcccgaaagtcaccatcatgagaccctaaagcgtaaattcaatcccgaccacagttggtggtatttttgcccggaaatatttttcgatagctattgaatctgcattgcaaatttaataaataagctgaatgagtcaggcgcgaataatataaattccaaagaataacggcagaaggttttcctcctgccgcagaaataacgaaccgggttttacactcaaataaacgtaaaaatctcgtcacgcggcaggcgggattttggcaggctggcgttaaaatctttgtcgcttttcacgcccagcgacaccagtaccacgctggttaagcctttttcacgcagccccagcgacagatccagctcgcgggaatcgaaaccttccatcggcgtggcgtcgatgccgagcatcgcggcacccagcagcagaccgcccagcgcaaggtacacctgcttttccatccactgcggcacatcgcgcagttcatagcgatgcatatccacgtagccacggcggcccttatcctgcccggctttggcttcttcgctggcgaagcggccatctttctgctcctgttccaacacgttttgcagatgttcttccgtcagatcgcttttcatgcacagggcgattacgtgggaagcattcagcacttttgcttcgttataggaaaatgcaccgccagtggatttggcgatcgcggcgcggccttcggcggtggaggccaccacaaaatgccacggctgggagttcaccgacgacgggctgttttgcagcacgttcagcagggtttcaatatcgttttccggcaaagtctggccgggttcaaaagctttgacggtgtggcgggaaagcacggcatcattaagcgtcatcattttttcctttccaaaaagtgaaacgtaacggttgttcgcctgagaataacgccaaatccgacgcagaaaaacctgtccggcggtgcagcactttctctttaaagatgaaaatcaggtgcgcgctggcgcgtttctggcaacaatgaaggccgtttttttcctgttccggagagcgtcatgatccgcctcgaagatgtgaccttgtttgtgcgcgccgcggcgttaggcagtttttctaatgccgcccgtgaggcggatttattgccggggcaggtaagcgccgccgtgcaccggctggagcgcgatctggataagcggctgtttgtgcgctccacgcgcagcctgcggctgacggcggaaggggaaaaatacctgccgttcgcccaggagatgctggcggtggtgcaggcggggcaggagagtctgcacagcagcgatgatgaactccagggagagctgaaagtcgctgtgccgtcggatattggccgcaatgtgctgctgccgctgatcaccgatttttgcgcgcagcatccgaaaatcaccctgcggctgtcgctgtccgatcagatcagcgatatttttcgcgatccggtggatgtggcgatccgctacggtgtgctggataacagcagttatgtcgccctgccgctggcggagaaaaaccgccgtgtgctggtggcatcccccgactatctggccgcgcacgggcgtccggcgacgctgggcgatgtgacccatcatcattgcctgctgtacaccatgaacagccacgtccacgataaatggacgttccatgaaaacggcatgcgccgccagcttacggtgaaaagccggatgctgtgcgatgacgctgacgtcgcccgccgctgggcgattgccggaatgggcatcgtctacaaatcctggatagacgtcagcgccgatgtcgccgccggcaggctggaagtgctgttgccgcacattgccggcgaggcggcaccgcttaaccttatctgcccgcaccgtaagcaattttccccggcgatccgccagctgcacggcatgttgcgcgcgcagatgacggcgatcacagaccgactggccgccccgcgttaacgctgttgcagcgggcggcagatcgccagcatggcgatggcgctgcaaagcggcacggcggcgagcagcagccagggcataatcgcctgcggggagggcgtcagcgcgtggtcgagctgcccgccgagcagaaaattacccgccagcaccgccacgccgcccatcgaggcaagcgcgccgtaatgcgcgccgaggttatgttctccggcgaaacgcggcaccaaatccatgcccaccggcacaatgatcatctgcccgagcgttaacagcgtcaccatgcaaatggcggggatcagccgctgccagttatcgggcggcacgtcagcggcaaaaaacgccacgctggcaaacgacgcgctcaacagcccgaagccgagcggcagcgtgcgcaacgggccaaggcgacgggcaaaacgcgccagcggcagttgcaggcagacgatgagtagcgaggcgagcataaacagcggcccgagatcggtttcccggctgccggagcggcgcagttccaccggcagcgccagatagagctggttatagctgaacagataggcgctgtaggcgatgataaaagccacaaaacgcggctggcggaaggtctcccaccagggggtgatcttcagttcactggccctgcgcggcgtggcgggcaggctgaaaaacagcaccaccagcgcaacgataaacacccccgcaccggccagcgccacgcgctgaaaaccaaatcccgccagcagcgcgccgagcaccggccccagcaccgcgcccagttccccgcagatggcaaaaagcgcgaaccactcctggcggctgcgcttgccgtcggcttcgctctgcgtcccggccttcgccagcagcgcctcgatggcaggggaaaacagcgccccgccgacgcccgtcagacaggcgcccagcaccaccggccagaacgactcccccagcgccagcagcagatagccgctcacccgcaccagacagccgctgaggatcaccacccgcgcgccgaagcggtccgccagcgcgccgcccaccagaaacattccctgttgcgagaaagtgcgcaagccaatcaccagcccgatcacccatccggacagcagcaggtcgtcgcgcaggtaaatcgccagaaaaggcacaacggcatagaagccaatattaaagaccaactggcagccggaaagcagataaggggaggtgcgttttgttgcgtctgtcgaagtcgaaaacatgccataaccgaagttgagtgatgaaaattgacaatatattttgcgatgggtataagtccaccacttaagaatgatttgcatttacctgcgcgtagccactgatcctctggagtaagacgaatgccggttttaaagaaaacgctgttagctttaggaatactttgcctgagtacggcatccgccctggcgacgcactatccgttaaccatcgataactgtggcatgaaagtcaccttcgacaaagcgccggagcgcgtggtggcgctggggcagaactccgcagaaatcatgctgatgctcggtttgcaggacaaaatggccgccagcgctttctggccgacaaaagtcttaccggaactcgcgaagcagaatgaaaaagtcaaagtgctgaccgtggagatcccgacgctggagtccattctggcacaggagccggattttgtggcggcgcaattgccgttgctgctcgggccggacagtaaagtcgctaaacgcgaagattttgccgccgtgggcgtaaacagctatttatcgccgggcgtctgcaccaccaccaaaaacaccggcgacatctacggcagccgcaagcagatgtgggacatgacccagctgtacaaagaaattaacgacctggcggcgattttcgacgtgcaggatcgcggtgatgcgctggtggcgagcttcaaaaagcgtgaagccgatctgcgcgagaaattccataagggcaataaagatctgtcgttcgtcttctggttctccagcgcctcgccgtcagccgatgcgcacatgagcggcaaaaacagcgcctccggctttatcgcgaatatgctgggcggccacatcgccctgaataccgacgccgaatggccgacggtgagctgggaaagcgtgatcagcgccaacccggacgtgattgtcgtcgccagcctcgaccgtaaccgctgggtgctggatcgcgcggaagaaaaaattaaattcctgaaaaccgatccggcggtcagccagctggatgcggtgaaaaaaggccatatcgtggtgatggatggtcaggcgatgaacccgaccgtgcgcaccctctatggcgcggagcaggtggcggcacaattagagaagctgggtctgaactgatgactgtggcgtcccgctcggtagttgaaaatatgcgatccgtgatgttgctgctgggcgcggtgctggtgctcggcatcaccatcgccttcagcgtcggggtgggcgagctgtcgatcccgttaaaaaccacgtttttcgccatcaccaataagctcggtctgaccggcgtaaccttaaaccgcatccatgagacggtgatctgggattttcgtctcagccgggcgctggttgccgcctgtagcggcgcggggctggccatctgcggcgcggtgctgcaaagcctgctgaaaaacgcgctggcggagccgtatgtgctgggcgtgtcagccggtgcctccaccggggcagtagccgtagtggtactgggcgtgggcgccggggcggtgtcgctctccgccggggcatttatcggcgctttcgctgcgttcctgttcgtcgcgctgctgaccaacggcgcgcgtggcggcaatgaacgtaccattcttgcgggtgtggcggcgtcgcagctattcaacgccctgaccgcctacaccatcagcacctctgccaatgcgcagcaggcgcgcgatgtgatgttctggctgctcggcagcttcagcggcgtgcgctggccggagttccagctggtgctggtggtggtgctgattggccttgcggtgtgtctgtaccacgcgaaagcgctggacgcctttaccttcggggatgacgcggcggcatcgctcggtattcccgtcggtgtgatccgcttgatcctgttctccgtcacggcgctgatgaccgccgcgatcgtcagcatggccggttccatcggttttgtcggcctggtggtgccccatatgatgcgctacttctttggcccgctgcaccgcaaactgctggtggcgtccgcgctgatgggcgcgattttgatggtgctggcagatatcgcctcccgcacggtgatcgccccgcaaagcctgccggtgggcgtggtgacggcgctggttggcgtgccgttctttgccgttattctttatcgctcggggaaattttcatgagtatcagtgccgaaaatctgtcctggcgtatcggaaaaaaagtcattgttaatgatgtgtcgctcagcgtgcccaaaggccagaccatggggctgctggggccgaacggctccgggaaatcctctttgttgcgtattctggcgggactgcgtcggcccgacgcgggccgggtgatgctggacggcggcgatgtgcgcgaggtcggcaaaaaagcgctggcgaagcgcgtggcctttgtggagcaacatgcggcgacggattccaacatcaaggtgatcgatgtggtgaagctggggcgcattccgcaccattcaccgctgtcgccgtggacgcatgcggatgacgagattgtcaccgccgcgctggcgcgcgtggagatgctcgaccgccagcagcagggctggcagagcttgtccggcggcgagcgtcagcgggtacacattgcccgtgcgctggcgcagtcaccctccgagatcctgctcgacgagccgacaaaccatctggatattcaccatcagatgcagctgatgcggctgatcagcgcgctgccggtcaccagtattgtggcgatccacgatctgaatcatgcggcgatgttctgcgattcgctggtggtgatgcagaacggcggcatagtggcacgcggtacgccggacgaggtgctgaccgaagagatgctgcgcgaggtgttcaacgttgaagccagaatcgaaatttcccgctacaacggcaaaaagcatattcactttttgtagggggatgcggtgcagcgccgggagccgggctgcgccgcctgtatccggcacgaagtgacattaattgagcgctgccagcgtcgattcgatcctttttatcctctgctgcgccgctttcagttcatcctggagccgctgctcctgctcattgtaagccatcagcacaatgcatccgttcatcacttttaccgttacctggtgtccggtatcgaaccccgcttcacgtagccatttccctttcaggatcaggttcggcgtgcttttatcccggccatgcgggcgatagcccacgatcacggaacgctcgctttttctaatctctgactctggggtagaatgcggatcagccataatcaactccttgatagttggtgaggttagacgctccggctgtgttgctgcacatcggagcgttgtttaattcctgcgtgtatgtggtaggtaccacatgcgtataaactaaccgaaatggtacctaccatgcaagaaaaaaagaaaccaacctttgaccgcaccaaaagcaccatgaagaacattcgttttgaagatgagcttctggaacagattgagaaagcggcgggaaaagggaattttagtaagtgggtgaaagatgcctgcaagatgcgattgcagaaaaactaatccgccagctatgcaggaaggctgcagtgaagcctattgacctacctgacggctgccttcctgttgaacttgtaagtaagacttacaggttgcattttgttcaagttcgccttcttcgtagatccctttgatgtgctgcgtaacggcctgcggggtaatctgataaagatttgcgatagttgcctgagggagccatagcgtctcctgttcaaagcgacattccacgcgcacttcgccgtcatcactggcaaacataataaactcgcctgccggagcctggcctgaaagttcctctgtcatgctgcctccttaaacgctggacgaaaattatctgggaatctatcagaatgttaagcattcacgacgttaccatgaatgccataaacacggttatcaacatagtatgtgaaaacaaacaggagtaaaaaaacagaaatgaaacgtgggggtagttcgcaaaatttgcgttaagttggagaacattgcagaggatttacgccacaagtggcggaagatcacaggagtcgaacctgcccggcaccgctggcggcaccaactggatttgaagtccagccgcctcaccggagacgacgatcttcccagccttcattgctacatggaggcggggcgcattatagccactttcctgctgtaaccacataccccgtcacacttttttatcagatctgcgtcaaaccttcgtctggttttggttaaaaccctattaaatccattgcttatcctcccgcctcattttcagctaccccgatcacataaaacaagaatcgtaatctgataaccagaaaacggaatacccgcttccggaacgatggtttaaaacgtctgcacctggtatcggcgtacttctgagcaaaaggatgaaagatgaagagtcagattatttctgtgaaggagaagattggctacggcatgggtgacgccgccagccatatcatctttgataacgtgatgatgtacatgatgtttttctatacggatattttcggcatccccgccgggtttgtcggcaccatgttcttactggcccgggcgctggatgcgatttccgacccctgcatggggcttatcgccgaccgtacgcgcagccgctggggtaaattccgcccgtggatgatgtttggcgcgctgcccttcggcatcgtctgcgtactcacctacagcacgcccgatctgagcatgaacggcaaaatgatttacgccgccgtcacctacacgctgctgaccctgctctacaccgtggtgaatatcccgtactgcgcgctgggcggcgtgatcaccaacgacccggcgcagcgtatctccctgcaatcctggcgcttcgtgctggcgacggcgggcggcatgctctccaccgtgctgatgatgccgctggtgaatctgattggcggggaagacaaagcgctgggttatcagggcggcgtcgccgtgctgtcggtagtggcgttcctgatgctgacgttctgcttctttaccaccaaagagcgtatccaggtgccgccgaacaccacgccgatgcgtgaagatctgcgcgacatctggaacaacgaccagtggcgtatcgtcggcctgctgaccatcctcaacatcctggcggtatgcgttcgcggcggggcgatgatgtactacgtcacctggatactcggcacgccggaagtgttcgtcgccttcctcaccacttactgcgtcggcaacctgatcggcagcgcgctggcgaagccgcttaccgactggaaatgcaaggtcagcatcttctggtggaccaacgccctgctgacgattttcagcgtggcgatgttctttgttccggtcagcgccagcctcaccatgttcgcttttatctttatcatcggcgtgctgcatcagctggtgacgccgatccagtgggtgatgatgtccgataccgtcgattacggcgaatggtgtaacggcaaacgcctgaccggtatcagcttcgcgggcacgctctttgtgctgaaactgggtctggcgattggcggcgcgctcatcggctgggcgctggcgggcggcggttatgacgcggcggccaaaacccagaacagcgccaccatcaccattattatcgcgctgttcactctcgtcccggcggcctgctatttcctcagcgcgatcatcgcgaaacgctactacaccctgaaaacgccgttcctggtgaaaatcatggaccagctggcgcagggcgtgcgtcgcaacgaacaggcgtttaacgagacacctgtcgccaaagaattaccgcattaaaaggagccgataatgaaaatcagtgatggaaactggcttattcagcacgggctgaacctcattcacccaatccaggtgttcgatgttgaacagcagggcaatgagatggtggtgtacgccgcaccgcgcgatgtgcgtgaacggacctggcagctcgacacaccgctgtttacgctgcgctttttctcgccgcaggaaggcgtggtcggcgtgcgcatggaacattttcagggtgcgctgaacaacggcccgcattacccgctgaatgtgcaggacgtaccggttgagatgcagaacacggcggagttcgccgaactgaaaagcggcgcgttaagtgtgcgtgttaccaaaggcgatgcctggtcgctggattttctgcgcaacggcgtgcgcatcaccggcagccaggtgaaaaacaatggctacgtgcaggacactgccagcaaccgcaattatctgtttgagcggctggatctgggcgtcggcgaaaccgtgtatggcctcggcgagcgctttaccgcgctggtgcgcaacgggcagacggtggagacctggaaccgcgacggcggcaccagcaccgaacaggcgtataaaaatattccgttctacctcactaatcgcgggtacggcgtgctggtgaatcatccccagtgcgtgtcctttgaaatcggctcggaaaaagtctccaaagtgcagttcagcgttgagtctgagcatctggaatattttgtcatcgacgggccgacgccaaaagaggtgctcaaccgctatacacagctgaccggccgcccggcgctgccgccggcgtggtccttcggactgtggctcaccacctcgttcaccaccaattacgacgaagccacggtgaacagctttatcgacggcatggcagagcgcgatctgccgctgcacgtattccattttgactgcttctggatgaaagccttccagtggtgcgacttccagtgggatccggtgaccttcccggatccggagggcatgatcaaacgcctgaaggcgaaagggctgaaaatctgcgtctggatcaacccctacattggccagaaatcaccggtatttaacgagctgaaagagaagggctatctgctgaaacgcccggacggctcgctgtggcagtgggataaatggcagccggggctggctatctatgattttacgaatccggaagcctgccggtggtatgcagagcagctgaaagggctggtggctatcggcgtcgactgcttcaagaccgatttcggcgagcgcattccgacggacgtggcctggcatgacggctcctgcccgcagaagatgcataaccattacgcctatatctacaacgaactggtgtggaatgtgctgaaagagacggtgggcgaggaagaagccgtgctgttcgcccgctcggcgtcggtgggggcgcagaaattcccggtgcactggggcggcgactgctacgccaactacgaatccatggcggaaagcctgcgcggcgggctgtcgattggcctgtccggctttgggttctggagccacgatattggcggcttcgaaaacaccgccccggcgcacgtctataagcgctggtgcgcgttcgggctgctctccagccacagccgtctgcatggcagcaaatcctatcgcgtgccctgggcgtatgatgaggagtcctgcgacgtggtgcgccacttcacgcagctgaaatgccgcctgatgccgtatctgtaccgccaggccgcgctggcccgtgacgcgggcacgccgatgatgcgcgccatgatgctggagttcccggacgatccggcgtgtgactatcttgatcgccagtatatgctcggcgatgcggtgatggtcgcgccggtcttctcggaagcgggcgacgtgcagttttatctgccggaaggccgctggacgcacctgtggcgcaacgatgagcttaccggcagccgctggcacaaacagcagcatgatttcctgagcctgccggtctacgtgcgggataacaccctgctggcgctgggaaataacgatcggaagccggactatgcgtggagcgacggcacggcgtttcagctgttcagcctggacgatggctgcgaagcccgctgcgaggtaccggcggaggatggcctggttgccttcacgctacaggcgcgacgggaaggggatcgcatcacgctcaccggcaccggtgatgcccgcaactggacgctgtgtttgcgcaatatcccgcaggtgagcgccgtgcagggcggctcacaggcgggcagtgagtggggggcagttatcaccgcgcaggagaatacgctggtggttacgctctgagtgttaaccctctcccgtcagggagagggtgtggtttccggctgcgcggtactcacctcgccgttgcgcatcgtctgtgtcacctgccgtttctctgtattcagcaccttcagttccgcattcaccgtgggttttaacggcgtatccgcttttacgttgccgctggcggttagctgaatattaccatcgccggaaatcggcagcgcaggccagccccactgctgcaatacgttcaccggcacgccgcgcccattgaggctcactttcacctggcgatcagccagctgcgacaccacagcggtggcttccagtaaaccctggccggtaaaggcgctcagctcgctgatgttgaccgcattggtgtttgcagccagcgccagcgacggacgacgcacatcgacgcggttaaaggtcgccgccgcgccgttcagtttggcgctaccgccccagacgccccatttaccgtcccgcgccagcagcaggttattaccataaccatccagcgcggtgatctgccacgggaaagccggatcgatgtcgatcaccaggttgcggctggcgctgaattttttcagcaccacggcgttcagccagccggggagaggatccatccacagctgtttccagttggcgggcagggtgtattccagaccggcgatggcggcgtcatccagcaccagcgctttgccgtcgcgcaaccagttgccggaggtgcgcagcaggccgccttcccagcgggaggtgaactggcgcagcgccacgccctggggggaaaactcagtattcacaataggatcgaacaggtgcagcgagccgtagataaactcgctggcgttcatcgacagcctgccgtcgtcgctctgccagtcgccctcgctcagcgtcaggttgcgcacgctcagatccagatcggttaccgcccagtccggcccctgcaggcgcgcgtctgtcacttccagcctgccaatctgcaacgatggcagcgtggtgagcggcataaagaaatcgctcagggatttgtcgctttgcaggcggatgtcattgagacgcaggctgtcgataatccagccgccgttggcggtacggcgggcggtaccggtgagcgagccgcgcgccatatccgcgccaatggtgctcagcgtcacctcattgttgtcgatactgccctgaatgaggacattactgatggggacgccattcagcgtcatggagcctgcgctcacctggatttgcgcctggctgccaagcacattgcccgctttcggctgccaggggctgacgccgcctgtcacccgctgggcactgagatcccagccagtcgccggactgttgaacgccatattgttcagttgcaggcggtcggcctggaagggcagcggcgcggtatccggagataaattcagcgtcccgtctgacagcaaaatagtatcggcatgcagcggatcggtgaactgacggctactcagcccaatatccaccgctttcgcatccagggtagcgggctggcccttgcggccaaacgtaacgctctttaacagcacatgggaaggcgaagaaaagcggtgatccactgcctcaacggtgagctggtaatcactgttatccgtaacccagtggcccacctgcgctgcgccccagcgcgtctggatcagaaaataggctgcaagaatcagcaccagcagcgcgatcagcagataaatcagcagctttccaatgagtttcatcgtcttcccttcctctatgcagacagggaatttatgcacgatttatgcgcaatgctcaaggagggaatggtgaaagcgtgtaacggcgacagcaggaaagccccgctgccgccgtgaaaatcagtttttctcaggcgggaaaacgaggttcagcacgatagcggtgataccgcccgcggcgatccccgaggagagcagattcttcagccagtccggcgcaaactgcaggatcagcggctgctgggaaacgcccagaccgaccgccaacgacagggcgataatcatgatcgcgcggcggttcagcggctcgcgggacacgatacgcaccccggaagcggcaatggtaccgaacatcaccagggtcgcgccgcccagcaccggctcaggaatgtgctgcacgaagccactcaccgccgggaacaggccgagcacgatcagcatcagcgccactacaaaaccgacataacggctggccacgccggtcagctggatcacgccgttgttctgtccgaaacaggagttcggaaaggtgttgaacaccgccgacacaaaggagttcaggccgttcgccagcacgccgcctttcaggcgcttcatgtacagcggcccggaaaccggctgttcggaaacgtcagaggtggcggtaatatcgccgatggtttccagcgaggtgatcataaataccagcatcagcggcagcagcaggctccagtcgatacctaaaccgtaatagagcggggtggggaccatgattagatcgctgctggtcggcgcggtgttctcaggcaacatacccagcgcccaggcgaggatataacccaccgccatagcgatcaccagcgaggccacgcgcagatacggattgcgctgacggttaagcaggatgatcaccgccagcaccgcacccgccagcagcaggtttttcggcgcgccgaaggtgtgatcggccatggcgccatagccgccgccgatagaggtcaggccgacctggatcagcgacagaccgataatcatcaccaccacgccggataccagcggcgtaataatgcggcgcgccaggtgcagcacgcgggaaaggaccatttcggtacagcttgccagcatcagggtgccaaacagcgccgccatcatggtcggcacatccgcgccgccggttttcagcgccgtgccgcccatgatcagcggggccacaaagttaaagctggtgccctgaatggataacagcccggagccaaccggtccccacgctttgatctgaataatggacgccacaccggaggcgaacagcgacatgctgatgatgtgctgcgtgtcctgagccggtaagccgagcgcctgacaaatcagcatcgccggggtgatgaccgcaacaaacattgccagcagatgctgacaggcggcaaaaagcgtttgtgccagcggcgggcgatcttccaggcggtagatcagctcactattatgctgcggcgcaaccggttgcgcattttcagactcgacggtgttaacggacatctctggcgatcccatgatggaaaagcggggattttatcggactgaatggtaaaagcaaacgtttgccagcaaaaaatctcataattaaaagggataaaaagcgaccgggatatagcgttatgcgtatgtcagagtgaatggctgaaaatttgcgtcaggcgttggaatagcgttcagtttccggcatccagcgctcgatcagcgcaagcgcctgttccggataacgctcatgaatatgacgggcgaggcgctgtacatcagggatcatcgcctggtcgcgcagcagatcggcgactttgaattcagcgttgccggtctgtcgggtaccgagcagttcgccggggccgcgaatttccagatccttttgcgcaatcacaaagccatcgttactgtcgcgcagcacctgcaggcgtttctgcgcggttttcgacagcggggatttgtacagcagtacgcagtgggacgccaccgcgccacgaccgacgcgaccccggagctggtggagttgcgcaaggcccagccgttccggattttcgatgatcatcaggctggcgttgggcacgtccacacctacctcgatgacggtggtggcgatcagcagatgcagctcgcccagcttaaacgcctgcatcaccgcctgtttttcggcgggcttcatgcggccatgaaccagaccgacgttaagctccggcagcgccagcttcagttcttcccaggtggcctcggctgcctgggcttccagtaaatcggattcttcgatcagcgtgcacacccagtaagcctggcggccttcgctcatgcacgcctggcgtacgcgatcgataatatcgctgcggcgcgtgtcgggaatggccaccgtggtgacgggcgtacgtcccggcggcatttcgtcgatcacagaggtatcgagatcggcatacgccgtcatcgccagcgtacgcggaataggggttgcggtcatgatcagctgatgaggatgaaagccctgttgctggcctttttcccacagcgccagccgctgatgcacgccaaagcgatgctgttcgtcgatgatcaccagcgccaggccgttaaactgcacctgttcctggaaaatggcgtgggtgccgacaatcatctgcacctgaccgctggcgatggcatcctgctgcgccacgcgcgctttgcccttctgtttacccgccagccagccgacttcaatgccgagaggggcaaaccaggcgcggaaattgttagcgtgctgctcggcaagcagttcggtgggggccatcatcgccacctgtttgccattggcgatggcgcgcagggcggcaagggccgccaccagcgttttaccggagccaacgtcgccctgcaccagacgcatcatcggaatatcaagcgccatatcgtgttcgatttcggacaccacccgtgcctgcgcgccggtcggtttaaacggcagtgacgccagcagctggtttttcagctcatcctgcgcggcaagcggctgggcgtggaaacgctgtgcgccggcgcgtaaggccagcatactgagattatgcgccagcagctcttcgaggatcagacggcgctgggcgggatgctgaccgctttccagatcggcaagttgtaaggtcggcggcgggcgatgcagcgtgcgcagcgcttccggcaggctcatcatgccctgggctaattcagcgggcagcagttcggcaatggcgcaggtgtccagcagttccagcgcctggtccgtcagcttgcgcagcgtcgcctgtttgatgccttcggttgtcggatagacgggggtcagggtgtccgccagcgccgggctggtcaggtcgccctgcacgcggtattccggatggatcatctccgcgccgtacttaccgcgctttgcttcaccgtaagccagcacgcgttttcccgtcgccagactgtttttcatcgccgcgctgaagttaaagaagcgcagggtcagaatgccgctgccgtcgctgatctgacaggtcatcatgcgacggccgccaaaggtgacgttacagttcagcacttcgccttccaccgtggcataaatgcccggcagcagatcggcgatggtgtaaagctgggtacgatcttcgtagcgtaaaggcagatgcaggagcagatcctgcacgttgacgaggccgattttggcgagcttgctgctctgcgccgcgcccacgccggtcagcgagcttagcggaatggcgtcaagcaggcggcctttcatgggttatttcgcagactgcatggtggcccaccacgcgtcatcggcttcgatttcgccctgcgcgttgacgtgggggtagggcaggcctttgcgttttgctacgcgggccagcaccggatagccgccttcaaacagcaaacgctgctgttcgtcttccggcagcatgctgttttcccgcttatacaggccggcgttctgccgctggcgctgggcttcatacagaatgagggcagaggcgacggagacgttaagcgactgcaccatgccgatcatgggaatgatgatgtcctgatccgccagatccagcgcttcctgcgtgatcccggttttctcctgacccatcagaatacaggtcgggcgggtgtaatcgatctcgcgaaaatcgacggctttatcagacagatgcgtcgccagaacctgcatgccctggcctttgagatgtgaaacggcgtcgctgatggtgcgatgggttttaacctgcacccagctgttgctgcccgccgcggaagaggccatggtgcgcatacggctgcccggccagacggcgtgcacttcatgcacgccaacggcatctgcggtgcggataatagcagagacgttatggggcttgtggacctgctccatgcagaccgtcagatcaggctgacgcctggcgagcatttcgcagattcgcgcataacgctgtgcattcattaggctagtttcggttacgggtgactttaatcacgtccggcaatacgcggattttacgcatgatgtttgccagatgaacacgatcctgcgcggtcaggcggataaaggcgctgtacacgcggccatctttttcttcagtattcaggctctgaatattggaagaggccgtgttgattgccgcagtcaggtttgcgagcgcaccctggtggttaaacatatccaccttaatttcggtgataaattcctgcgccgtgtctttgtcccactctaccgccataaacttctctggctctttctgatagccacggatgttacggcaggattcatggtggatcaccagtcctttaccagggctgacgtgggcgataatcgggtcgcccggtagtggacggcagcatttcgcgaaggtgatcagtaccccgtctgcgcctttgatcggcagatgtccatggccctgacccgcctgcaccggggctgctgtttcaccctgttgcaggtttttcgcgaccacgacgctcatggcattgccaagaccgatttccgccagcaggtcgtcaagggacgccagcttcatgcgctccagctcatgctgaatattttccggcgggatttccgccagcttgcggctgccgccaagggcatggttaagcagacggcgacccaggcttacggaatcgtcgcgcttgaggtttttcagcatctggcgaattttggcgcgggctttggagctgaccacaaaattgagccatgcggcgttcgggcgggcgccaggtgcggtgatgatctcaaccgtctggccgctggcgagcggctgcgacagcggatacggctgtctgtccacgcgcgcgcccacgcaggcgtggccgatgtcggtatgcacggcataggcgaaatcgaccggggtggcaccggcaggcagctcaacaatgcgcccttccggtgtgaaaacataaatctcatccgggaagagatcagatttaacgctctcgataaattcaaacgaactaccggcgctctgctggagttccagcaggctctgcatccagcgctgcgcgcggatttgcgccgtggtgctactttcaccgtgctctttataagcccagtgcgcggcaacccccatttccgccatcatgtccatgtcttcggtgcggatctgcacctcaaccggcacaccgtgcgggccaatcatcgaggtgtgcaaagactgatagccgttcgcttttggaatggcgatgtaatctttcatgcgccccggacgtggcttgtagaggctgtgcatctgaccgagcacgcggtagcaggtatccagatcgtggacgatgacgcggaaggcgtaaatatccatgatcgagtggaaacgctgctctttcatgaccattttgcagtaaatggagtagagatgcttttcgcgtccgcttacgcgacagggaataccggcttcctgcaaacggccttcgatttcagagaggattttctggatcatctctttacggttaccgcgcgcagatttcaccacctctttgatcacccgatagcggttcgggtgcaacgcctcaaagcccagctcttcaagctcggttttgatgtgatggatacctaaacggtgcgccagcggactgtagatttcgagggtttcacgggcgatgcggcgacgtttatccgggcgcagtgagcccagcgtgcgcatattgtgggtgcggtcagccagtttgatgagaatgacgcggatatcctgcaccatcgccataatcatcttgcggaagttttcggcctgcgcctctttcttgtcgcggaacttaagcttatcaagcttggacaccccttccaccagctcggcaacgcttttgccaaacagctgttccatgtcctggtaggtggcgggggtatcttcaatcacatcatgcagcagcgcggccatcagtgtttcatagtcgagtttcatctcggccagaatacaggctaccgcaaccgggtgcgtgatgtagggttcaccgcttgaacgtgtctggccctcgtgagcgtcacgtgcaacgagatacgcctgctggagacgctttatctgctcttccggcagataggtttgaatcagctgattcaggctttcaaacagatacaagggtgacctgcagtgttattaacgacgaccttcagcaatcgcggtgacggcctgtaattcagcggcttcctgctcttgctgctcctggcgctcacgtacgtcgaggatctggttgttgatcagaccttcttcgatttcgcgcagcgcgataacggtagttttatcgttctcttccgcaaccagcggatctttaccaccaacctgcatctgacgagcgcgacgcgcggcgaccagtaccaggtcaaaacggttaccaattttctctacagcgtcctgaacagttacgcgtgccatacttaaagtgctccacaggtgaagaaatgactgggcatgatactgaaagtacgttcagtctgccaatagtttgctgattaaagcgtcatgtcgctgtttttggcgacccatacgcagacgttcagcacgaataatggtcttcatatcgctgatggcggtatcaaaatcatcattcacaatcagataatcatattcggcgtagtggctcatttctgcaaccgcctgcgccatgcgtttggtgatcacctcttcgctgtcctgaccgcgaccgcgcaggcgacgatccagctcgtctttcgacggcggcagaataaagatgctgcgcgcctgcggcattttctggcggatttgctgcgcgccctgccagtcgatgtcgaggaaaacgtccacgcccgtcgccagaacttgttcaatggcgtcgcgcgaggtgccgtaataattaccaaacacttccgcatgctcaagaaacgcatctctgccaatcatgttcttaaattcatcatgatccacaaagaaatagtgttcaccgtgcacctcacccggacgcggcgcgcgcgtggtgtgtgaaacagaaacctgggtgtcgtacaacggttgggtctttaacaaagcctgaatgaggcttgatttacccgcaccactgggcgcggaaacaatatagagcgtgccttgagccatgagtatcttttgtatgtgatgaacgaacgggaatgtctacatacgtgcctattatacacgtcgccgctacgtgacgtagcctttgtcacacttttgcacgagattattgcgttttgcgaggcgttttcctgaattatctgccgcttgcagcaacagcgcaaaattcccggaagccgcctcgcaaggcggctttttgctgctcgtcttgcgtcagacgtcgcgctataccgaagcgaacacagcaagggaggcagaacatggttaagcgtgtgggatggatactgttcatcttgttcttaagtggcggcagccgggcggcatgcccggtatggccgcctgcacgggcagagcaggagatcgcgcggcttcagcagcaaatcatacagtggaacgacgcctactggcggcagggcaaaagcgacgtcagcgacgaagtttacgataggctcagcgcccggctggcgcactggcagcgctgctttgcgccgcccctgccgcttgatgaacctgcaccgccgggcacaggcgccatcctgcatccggtcgcccatacgggcgtaaagaaactcgcggataaaaccgccctgacgcaatggatggcaaacaagcgcgacctgtgggtccagccgaaagtggacggcgtcgccgttacgctggtttatcgtcagggtgaactggcgcaggctatcagccgcggcgatggcctgaaaggtgaagactggacgaataaagtgcggcagatcccctcgttgcccaaaaagataaacggcccgctggcaaacagtgtcctgcagggcgagatttttcttctgcgtgataaccaccgccagcaggaaatgggcggcatgaatgcgagggcaaaagtggctggcgcgctgatgcggcaggggccttcccctctaacccgcgaactggggctgtttatctgggcatggccggacggcccacaggatatggcgcaacgtctacaacagcttaacgaggcgggctttaagtgggttttgcagttcagccagccggtaaaagacgcgggtgacgtggaaacccttcgcgcccgttggtttgccgcgccgctcccctttgtcactgacggcgtgatcgtcagagcggcgcgtgaaccggcaggtcagcagtggttgccggggcagggcgactgggtggtggcatggaaatatccgccagcggtacaggtggcggaagtgaaaaatatccgctttaacgtcgggcgcagcgggaaaatcgcggtggtggcagagcttgagccggtacagctggatgataaacgtgtggggcgggtcaatatcggctcggtccggcgttggcaggagctggacatcgcccccggcgatcagctgcaaatcagccttgccggccaggggatcccacggattgacggcgtggcatggcgcaacgcttcgcgggacaagcccgcgccgccctcatcccgttttaattcgctgacctgtttttatgcggcgccagagtgtgaagcgcaatttctggcccgtctggagtggctaagctctccgcaggcgctggatttaaccgggctgggggaggcagcctggcgcacgctgcaccaggcctggcggtttgagcatatattttcctggctgatgttaacgcctcagcagttgcagcatacgccggggatctcaccggccagagggcaaaaactgtggcatcagtttgagctggcccgtaagcgcccgtttattcgctgggttatcgccctgggtacgccgctgtctcagggcgcgctgaaggctgcgggagattatcgctggcaacaactgctggaacgaactgaacagcaatggcagcaactgcccggtatcggacaggaaaaagccgggcaactggtggcctttacgcaccatgccgcgctggaaaagctgacggcatggctgggcgaacagggaatgaacggcttttaatacggcggcttaatgtacgttatgcgtgtagtgaaagacgggtaaacccagcttcaggcgcagcgccagcaggcgggcggtaaaaccaaacagcagggtggcgatgaccaccacgtcatgactggagacataatgttgcagagcaatatagagcaccgcagaggcaaaggcgacgccagcgtacagctctttctgaaacaccagcggaatacgtttgcagaacatatcccgcagtacgccgccgaagacgccggtcacgactgcggcaatagtagcgatgatcggcccttcgcccatatcgagcgcaatctgcgccccgatgatggaaaacaccaccaggcccagcgcgtccagcaccagaaacagacggcgaagatggggcataacaggcgcggcaatagtcgtcagcaccgcagcggtggcgacgataatcacgtattccgggttttttacccagccaagcgggtaatgccccagcagaatatcgcgcacggaaccgccgccaagggcagtcgcggtggcgataataatgacgccaaaagtatccatacggcgacgcccggccgccagcgcacctgtcatggcttcagcggtgatcccgataatataaagaatgtgtaacagcatgcgcgcccccgttagtgaaggcgcagggtagcgagtagtggcagggatctcgattgagattttttcagggtcagtctaatcgattactataacttatgcattttttgaccagcactgccttcagaagcagaaaagccaataaaaatgcattagaaattgtatggcatatctcgggcttaacggaaaatttctttaaacattggcaccagtacgcggttgcctgtttcgctcagatgattgtcatcaaaatagagaggctgcaggtttttactgcccatacagcggccatctgtacataaccagcgggaaggatcgataaccttaacgccacactgattgactgctctgtcctgcgcctgccagataaattctgttttcttacgatactccgcctcctggatggagacatcctgcggctgtttacccatcatcagagcatgggaaaggtagcggggtacattgacattcatttcagggacaggacgaacgaggtaaactttatgatgttgattcagcgcgcaggccatcgagatcatcgactcggcataagtatgcaaatactggatcccaacgatgttcttatcatcaaaatgcaccagatggctttcggcataatgacccagcctgttgacgataaccaccggtgttgtggacgggatatccgcaagccgtgcggcaagggatttgttgaatttgtaacagccttcgtttttatcgacgtgggcatcagaaaggttagggcatccggaccatgtcatacccatcaccgaaccatgcccctgtgcggcggcggcaagcgctgtggctgtggcctcggcatgactgtcacccacgataacggcagccagcggccctgtaccgtaataactgagcgacgttttaggatcggctgcgcggtttttattttcggcttcgttggcaatctgattaaccaacggattgggagaattcaccagcgtttgatacttaacgagattgccaaaaatataacagcctgacaccgttgccagcaccaccagccagaatgccggagcagataagcgggacagggacttgttcgccggttgctcaattaatacccatgacaaccagcccagcagaaatgagagtgctatgccgctggtgatccataacgcattgtgctggcgatcggcgtagacaataaaaacggcgatcggccagtgccacaaatacaccgaatatgagctaagaccaatccaccgacaatggcgatcgatactttctgccagcggttggtaattgcttgcgatgaccagcatagtgcccagcacgggaaaaagcgtcaggtatccgggccaggcgccatccggcgtaatcagcaccactgaggcggctattatcagataaccgaccagtgcgcagaggcgtgcccgggcgcgggagaaggtataacgctgtgaaataaaccacaccagaccgccgcagagcatctcccatgcgcgaaacggcatcagataaaacagagaagaaagatttcctgcgctggcataaatcacacagccgataaaagagcatatggcgagcagcattaatgaaaacatcatgctgatgcgttttctgaccagatgtaacgccattaataacagcggcagtgccagataaaactgccattctaccgagagagaccatgtatggaggagccagttttcatgtgaactggtagcaaaatatcctcctgcatctttatttaattttatgttagaaataaagaggatagcgtagctaatgtagttaccgagtcgccggaattcgagcgctggtagccagaaccacatcaataatggcaacagaagacacaacgccagaagcgccggaataatccttttacaacgcgcggtataaaatcgccgcaaactgaatgtctgcgcttccagccctccggcgatgatttttgtcatcagaaaaccagagataacaaaaaacacatctactgcggcaaagccaccgggtaataactgtgcggcaaagtggtaaaaaacaacggatacaatggcgatcccgcgtagcagattaatgtcctgacggaactgactatcgactgagtagcgttcagtgctctcaattgataaagaaagatttgccatgccataacctgtgaaatgtctgtgcggaaccagaaaggcggcgagtataccaagcttcataagaagtttcttagcgttacccgccgtaatggtaataaaatatgatcttattaacagattttttctaaaaagggagtaatgcggaaaggttaaatgccgtgccctgaataataaaagcccgtcatcaggcgggctttttaaagggattaagttactgatgaatattactattcgatattctggatctgctcacgcatctgttcgatcagcactttcagctcaatcgcagaattggtcacatcagcgttgatggatttggacgccagggtgttcgactcgcggttaaactcctgcatcataaagtccagacggcggcctaccgcttctttcttcttaagaatgttgtaggtttcttttacgtgggcttcgaggcgatcgagttcttcagcgacatcaatacgctgcgccatcagcaccagttcctgctcaagacgattattttccagctgtacctgggcgtcttccagtttggcgaccagacgctcgcgctgccatttcagcacttccggcatctgcgcacgtaccttagccacttcctggctcacgccttcaagacgctgctcaatcagggttttcagcgcctggccttcggtttcgcgggcgatgataaagtcgtccagcgcgccgtcgagagccgagaggatttctgcggcgatcacgtccagatcctgttcctgcgcggccatcacgccaggccagcggagaatatccaccggattgatttcgccttcatcgctctgcattttgacccagttcgcggcggtcaccagctgcttagccagtttttcattcaggatcagttcgctctgcgcgctgacgtcaggctcaaaacgcaggttacattcgattttgccgcgcgtcagacgcgtgcggatccgctcgcgcactacgggttcgaggctgcgaaactgttccggcaggcggaaccaggtttccagataacgctggtttaccgagcgcaattcccagactgcgctgccccattcacccttgatttcacggcgggcgtaggctgtcatactgcggatcataaacgttcctgttttgaaggagagatggggggattatagctttcagggcttacacaggataggaataagcgactttaatccgtataatgcgcagccacattcgtagaagccggagaaatcatcatgcgtccagcaggccgtagtgccaatcaggtgcgtcccgtcaccctgacccgaaattatacaaaacacgctgaaggttccgtgctcgtcgaattcggtgataccaaagttctgtgcaccgcgtccattgacgaaggcgtgccgcgtttcctgaaaggtcagggacagggctggatcaccgccgaatacggcatgttaccccgtgcgacgcatacccgtaacgcgcgcgaggcggccaaaggtaaacagggcggccgtaccctggaaattcagcgcctgattgcccgttcactgcgcgccgccgtggatctgaaagcactgggcgagttcaccatcacgctggactgcgatgtgatccaggcggatggcggcacccgtaccgcgtctatcaccggtgcctgtgtggcgctggccgacgcgctgaacaagctggtggcagcaggtaagcttaaaaccaacccgatgaagggcatggtcgccgcggtatccgtgggcatcgtcaagggtgaagcgctgtgcgatctggagtatgttgaagactccgccgctgaaaccgacatgaacgtggtgatgacggaagatggccgcatcattgaagtgcagggcaccgccgaaggcgagccattcacccacgaagagttgctctcgttgctggctctggcccggggaggcatcgaatccatcgtcgccatgcagaaggcggcgttagaaaattgattttaaggcgacttgatagtcgccttttttatgtctgaaaaaagcttaaggagcaaatccatgaaaccgtatcagcgccagtttattgaatttgcgcttaacaagcaggtactgaaatttggtgaatttaccctgaaatccgggcgcaaaagtccgtatttctttaatgccgggctgtttaacacgggccgcgacctggcgctgttaggccgtttttatgccgaagcgctggtggactccggcattgattttgacctgttgtttggcccggcttacaaaggcattcccattgccaccaccaccgcagttgcgcttgcggaacaccatgagcgtgatgtgccctactgctttaaccgtaaagaagccaaagatcacggcgaaggcggaagccttgtggggagcgcgttacagggccgcattatgctggtggatgatgtgatcactgccggaaccgccatccgcgagtcgatggagattattcaggcgcatggcgcgaccctggcgggtgtgctgatctcccttgaccgtcaggaacgcggacgcggcgagatttcggcgatccaggaagtcgagcgtgactatggctgccaggtgatttcaatcatcacgctgaaagacctgattgcgtatctggaagaaaagcctgagatggcggatcatctggcatcggtacaggcgtaccgcgatgaatttggcgtttaaataaattttgcccggtggcgcgacgcgtaccgggcatacttaacgttactgcagctgcgcggccatcagcggccagcgggcgtcaaagtcttctgtcggacggtatttgaactcgctgcgtacaaagcgcgacagcattccctcacagaaggccagtaactggcttgccagcagtgcttcatccacggtatagccttcgccttcacgcatttttcgctcgcgcagtacctggcgcagttgcgattcaatacgatcaaacaactggttaatgcgaccctgcaggcgatcctgctcaaacatcagcgcgtgaccggtcagaatgcgcgtcaggcctggattacgttcaccaaatcccaccaccagcagcacgataagacgcagacgcgtggtcgtgtctttttcgtctttcaggatcaggttaatacgcgtggtcaggctatcttcgataaattcaatcaggctatcgaacatacgcgttttactgggaaaatgacgatataaagccgcttctgaaacgccaacggaggctgccagcttcgccgtcgtaatgcgctggctgccatcgctggattcaagcatcaatgccagagattgaagtatttcttcgcgacgattccttttcgcagtttgtttttctgccatgttccaaaatacccctgaaaataagcacttgtcaggcgggcatccacgcagcgaccgcaaaccgaagtttgcggtaatgttattactttatggcgctgtgggatgcgtttataaagccgcttattgacggcctgaatggccgaagccgccttcaccacgttcggtggcgtcgaaatcttccaccagattaaattctgcctgtaccaccggcacaaaaaccatctgggcgatgcgctcgccaggttcgatggtgaagctggtttgtccgcggttccagacggaaaccatcagttgcccctgataatcggagtcgatcaggcccaccaggttacccagcaccacgccatgtttatgccccagccctgagcgcggcaggatcaccgctgccagcgttgggtcagcaatgtggatcgccagtccggtcggaactaaagtggtggcgcccggcgccagttctacggcgtcatcaagacaggcgcgcaggtcaagaccggcagagccggaggtggcataggttggcagcggaaattcctgcccaacacgcgggtccataatcttaacgtcgatttttttcatcataacgggtaacgatctcgtccagtagttgttggcccagaagtgccttgctctcaagcggtaagactttatcgccgtcctgccagaacaggtgcagtgcgttgttatcgctgttaaaaccctgctgcgcgccggaaacgtcattggcgcaaatcagatccagatttttacggctgcgcttttgccgggcgtattcttccacattattcgtttcggcagcaaacccaacaacataggggcgatgcgcggacagcgcggcgacgcccgctacgatatccgggtttttcaccattttcagtgtgatttcatcgccttgctttttaatcttctcatcggcaacggcggcggcacggtagtctgccacagcggcgcaaccaataaaaatctgctgcgtttgcacattggcctgtactgccgcttccatttccagcgccgtggtgacgtcaatgcgcttaacctgcggcggcgtggcaagcgtgaccggcccgctgaccagcgtgacgttcgcgccacgtcgggcggcagccgcagcaatggcgaagcccattttcccggagctgtgattggtgatgtagcgcaccggatccagcggctccctggtcgggcctgcggtaatcatgatattcagatgttgcaggtctttgacaggcgaaaaatgcgccgcggccagatcgacaatctccagcgggtcgagcattcgccccgggcctacatcgccacaggcctggctgccgctgtccggcccccagagcagtaagccgcgggaagccagtacgcccagattatgctgggtggcggcggcgcggtacatctgctggttcatggctggcaccacggcgaccggagacggagtggcaagacaaatggtcgataccaggtcattggccatcccggcggcaacgcgggcgattaaatccgcggtggcgggggccaggatcaccagatcggcccattttcccagttcgatatgccccattgccgcttcggctgccggatcgagcaggctgtcggaaaccggatagcctgacaccgcctgtaaactcatgggcgtgataaaggctttggcggcctcggtcatggcgacacgcacctccgcgccgcgatcgcgcagacggcgcaccagctctggcgctttataggctgcgataccgccgctgacgccaagaacgatttttttaccggccagactcatcatgattctttcctgttggatttcaccagaaggcgggcattttatcacaatcctccacctggcgtgcttttgcgcattgcgcactttgcgaggcgctacgcaaagccgttaacccgctttgtggcaggataggcgctcgacagggaggtgacattatggaagaaacgttatctatactaccgcgtgaaaaaacgctgctgtttggcgtcaaatcgctcagcgatgttgaattactggcgctgtttttacgcaccggcacacccggaaaaaatgtcatggcgctggcgcaccatctgctggggcattttggctcgctgtatggtctgctgaccgcggaatttgaaacgttcagcgaggtgggcggcattgggctggcaaagtatgcccaactgaaaggcattgccgaactggcgcgccgtttctatgaggttaaggtggcagaggagtttgccatcatgtccccggatgtcgcattagcctttataaaaagtcagttaacggcggaagagcgcgagatctttatggtgatctatcttgataaccagaaccggatcctcaagcactgccgcctttttaccggcactatcgccaatgttgaggtgcatccgcgtgaaattgtccgcgaagccatcaaaattaatgccgtcggcgtgatccttgcgcataatcatccttcgggcagcgcggagcccagtaaatccgataaaatcatcaccgaacatgtggtaaagtgctgccagttcatggacatccgggtggtagatcatctggtaattggccgtggagagtatgtttcatttgccgaacgtggctggatttaggccactttacgcgatccattgggatctttgtctgttcgggacttgagcacatcgattacacagcgtatactacgccacctttgagaatctcgggtttggcattatgggcctggcattgtgggttcacattgaaccgccagaggccaggtttgcagcctgacgaggcgccataaccctatacgaagctcgagctaatttgatttttggagaatagacatgtcccgagtctgccaagttactggcaagcgtccggtgaccggtaataaccgttcccacgcactgaacgcgaccaaacgccgtttcctgccgaacctgcactctcaccgtttttgggttgagagcgagaagcgttttgtcacactgcgtgtatctgctaaaggtatgcgtgtaatcgataaaaaaggcattgatacagttctgtccgaactgcgtgcccgtggcgaaaagtactaagtacttagaggaaataaatcatggctaaaggtattcgtgagaaaatcaagctggtttcttctgctggtactggtcacttctataccaccacgaagaacaagcgcactaagccggaaaaactggaactgaaaaaattcgatccagttgtccgtcagcacgtgctttacaaagaagcaaaaattaaataattttcgctttgatgtacaagaaccccgcctgtgcggggttttttgcattcagcctccggagaaatcatgcctgaattacctgaagtggaaaccagccgccgtggcattgagccgcatctggtgggtgaaactattctgcatgctgtcgtgcgcaacggacgcctgcgctggcctgtttccgatgaaatccatgccctgagcgacaaaccggtgctgagcgtgcagcgtcgcgccaaatatctgctgctggagctgcctgacggctggatcatcatccatctcggcatgtccgggagtctgcgtatcctgccctatgaaatgccggcagaaaaacatgaccatgtcgatctggtgatgagcaacggcaaagtgctgcgctacaccgatccgcgccgctttggcgcctggttgtggacgtcgtcccttgaagggcacaacgtgctggcgcatttaggccccgagccgctcagcgatgcctttaacgccgactatctgcgccagaaaagcgcgaagaagaagatcgccatcaagccctggctgatggataacaagctggtggtaggggtgggtaacatttacgccagtgagtcgctatttgccgccgggatccatcccgatcgtctggcgtcgtcgttgtcggcggaggagtgcgaattactggtgcgggtgatcaaggccgtgctgttgcgctctatcgagcagggcggcaccacgctgaaagacttcctgcaaagcgacggtaaaccgggttactttgcccaggagctacaggtgtatggccgggaaggtcagccgtgccggatctgcgccgcgcccatagtggccagcaaacatgcccagcgctccaccttttactgccgcaactgccagaagtaaaacctccgggcgctacgcctgcagcttagcgagtagcgcctgatgtacctgcgcaggcaggaagtgggtgacgtcgccatgatgacgggccacttccttgaccagcgatgacgagataaacgaccactcttttgacggcatcaggaagacgctttccagatccggcatcaggtgacggttcatttgagcgagctgcatttcatattcgaagtcagccactgcccgcagaccgcgaatgaggatattggcctgctgatcgcgggcgaaattcgccatcaaatcgctaaaaccgacgacttcaacgttagccagatgcgcggtggcctgacgcgccatttcaacgcgttcatccaggctaaacagcggtttcttccccggactggcggcaatcgccatgatgaccttgtcaaacatgcaggccgcacgggtgatgatgtcaacatggccgttggtgatgggatcgaaagtgccgggataaatggcttttgtcgtcatggcgcgctcttttctgagtagccgtggttcagcgcccacagcccggtatatttattaaaagtatactgcgcattcaccacggccagcagccagccctgtttgccgtcgagcacgccgccgcgcagcaccagcgttttcataaacgcgccgatcgtatgcgcaaagatacctgtaatgctggtcttcttgccctgctgatggtgctctttcgcccaggcggtggcgtagttgaactgcttttgctggaaactggcaaagtcgcggcaggtcagatgcagcagatcgccctgcaggtttaccatcgacgcacctgcgctttccagggattcatgcacggcattgctgttgtactgatacttttcccgcggatacagacgcatcacgcgatccgggtaccagccgctgtggcgcataaaacggccaagaaaatagttacggcgggcaatgctgtagatggtatctggcgcaggggaggccagcacgccctgaatggcccgggcgagttccggcgtgatgcgctcgtcggtgtcgatcatcagcacataatcgcccgtggcatacgcctgcgcccgctggcgctgaataccgtagccctgccagtcggtattggtgaagaccttgaccccggcgttgcgggcgatagtgagggtgtcatcggtgctgccggagtccagcagcacgatctcatcggcaaaggccaccgaagccaggcaatccggcaacagatcggcggcgtttttggcgatcatcaccaccgagaggcgcattagtggctccgctgcggcagataaggttgcaggagttgcagcagtcgtgagagcgcgccctgattctggtgcagcacctcaacggcatggcggccgtaccacaggcgataatcttcatcggtcagcaaggtcgagacttctttcaccagcgaatccgcatcggtaacggtgatcagaccatccgcctgttgcaacttggcgcaaatatctttgaagttgaaggtgtgcgggcccatcagcaccggaatggcatgcgccgccggctccagcgggttatgcccgccgcgctccaccaggctgccgcccacaaacgccagatcggcaatgccgtacagcagcatcagctcgcccatggtatcgccaatcaccacctgcgtgctgccggacgggatctcgccggtgctgcgcagggtaaagctgaagccgcctttctgcaccatatcgcgcgcgtctttaaaacgctccggatggcgcggcaccaggatcagcagtaaatcggggaaggtttccagcagcttgcggtgcgcctgaagaataatctcttcttcgccatcgtgggtgctggtggcgatccacacctgacggcgcggcgcccactgtcggcgcagcgtaatggcgcgcgccgccagctccggcgtaacggaaatatcaaatttgagactaccggtgacggccagctgattacgtttgaggccgagcttcaggaagcgatcggcgtcttcgtcattctgggcggcgatcagcgtaattttgcccagcaggcggcgcataaagttgcccagcttgccgtaaccttttgctgagcgttccgacaggcgggcgttggcgatcaccagcgggattttacgggcatgcagcgcggaaatcatattcggccacagctcggtttccataacgatgacaagctttggccgcacggtggcgagaaagcggttcatcgcgcagggtaaatcgtaaggcagatagacgtgatgcacgtctttgccgaaggccgacatcacgcgctccgagccggtgggcgtcatggtggtcacggtgatgggtaacgcaggataacggtggcgcagcgcacgcaccagcggaatggccgccagggtttcccccaccgacacggaatgcagaagaataccgtccggcttcactttgttactgcaatagccatagcgttcagcccagcgtttacgatacgcgggagccttgcggctgcgaagcaacaaacgcagccacaccagcggctggataagatagagcagggcggtatacaacaattccaagcgattatccgttttttgagtttcggcgggcaaattctaagcattaaagcgggctaaagctatacttttggcgcttttggtcacgcttttgccactgtttcgtacaatgcgaaaggggaaaacgaagaaccactggacggcacagggcagaaaagccctgtgcgcgggaaaaacgattactgctctgctggcgggagttcgttcagatgataggtgatccgctccgaaagaccccgaatatcaccgccggtgatgaagtagctgtcatctttctgattcgggttcgtcacctgataacccagcactttattgatcagcgtcgccagctggaaatggttcagcggcatctgcgggctgatgtttttcagggacatcgccggatcgttactgaaatagatgaacggcacctgcgcaatcggcatttccacgacggagtgcccgaacagcccgccgtccccgacgcgttcaccatgatcggaggtgataaagaccagcaccggcagtttcgatttcgccatcaccgtacggatcgcagaagccagctccttgtcgtaaagacgaacggcatcgtcatattcattttttttctgcgccacgtcatcatcaagatgcggggtggaaaacttcgcgaatccggccggaatgtttcgctcataaggaatatgcggtgcgcggctgttcagcaccatcatgaagggtttattccagtccagcggggctttttcaacggacggggtgaggatccggtcagcgcccacatccggggccggacgcacctgcgtatcttcccaaaaatcgatgtcatgaatgccaatccagttgctcagcccttccagaccctgcgctgaaataaacgcggtctgataaccctgtttcttcgcattggcaaaaatattggtcgctttgcttttatacgctgagaagttatccggctcgcgcaggttattgaccagcatcggaatggcgacacgtgtggagacggcgttagagacaatcagacgtccactgccctggtattgatccatcagcgctttcagttctggcgtggtctctctttcatagccgagcgcgctgacatgatgcgggttcagactctcgccaatggccaggatcaccgaatatttcccgttctggtggtctgcaaccggcgtgacctggtaaggctcgtaatgggcgatattctggttttcgcccgacagcgcttcggggatcagccttaccgcgctaaagctcatcgctgacaggccgttgcgcagcagggagtggcgcaggtcaggattgaatttatacatctggccgtcgatggctttgtagaactggcctaaaaacatcaccgctatcgccagcaggcagggggcggcaacccatttgtgccagtgcggcccaatacggcgggcaaacaccagcgcgaagacgatcgccaccagcatgatcacaaaataaatgcccagcgcaccgaggctgtcagtaatgccgctggcaatatctttcgtttcaacaaacgccagccacacttcgctcgggccatagaactggccataaaactggtggtagatcgcctcagatagctgcacgatataggtgatcgccagcagaacgcgcgtcagcataaaacggatgctgaccgccgcaagcagagagatgatcacatacagcgcaatatcacccgatttcgggctgtatgccgtgtctttaaggctgacaataatttcggaaagcgcaaaaaacgccgtaaaaatcagcgtaagagtaatggtcttaagcagatttcgtcccaacgaagggcgggacagcaatgacgatctgaacatgttttaacccgaatggttttagaatttcttggtcaggggacgaatggctttaccaaaaccaaagcgcaccgcgcgcacgaacgtcggacggttatgtaagcctttacgccagatatcctcaaacaaggcataccagcgggcagctacggcttcacgggagtaaacctgtagccgtttttcgccctgctcgcgcatttgacggaataactccggcgagtttttcagtcgcatgatggcggcaaaggcttcgtcagggtttttggcaatcagataatccagttcgctctcgcgaatagcgcggaatgacggctcgtcatcgcacaccatgactgttttacccagccagttattgatgagtttgctggctggcttacgggccagcttgtggtcatgagatttgcggaagctcacgcagacatccacatcgcggtaatccacccagttatcaaaggagatacgcagggtgatgccctgttctgcaagacgttgtttaaacgcttcgctgcggtactcttccgggaagctgtccacccggccaaagtaggccaccgtctgcacgctatcatcggtgcgctcgcgcggctgaacgcctggctgcggccagtagggcacgaaaatgcggttgctgtggccgtcaacttccgggttctgatcgacaacatagtctgcgcctattaccggcgggcggtcggcgcgggcgacgacagtgacgcctttccagggtttgacccgtgagccgaagtcatcgttatgcatcagattgatcgcatcaggacggcattcggaaccgaatgaacactcgattgcatcaccgtaatagtgcttcagagcaagcgtggtctggaatgtccagccaccgcgtccgccgcaatagaaacgttcaggaatggtgttcggatccgttcctgcggcaagcagcgcatcaaaatcggcgtagtttttggcgataaagtccgcccgggatacggcgtgcaatttaagcttattcataggttcgctttatttaatcagtttcttaagacgaaagtaacggcgtcccagacgccagcgctgacggaaaccgcgcgcattttgccagatcatggaccagatcccgcgggaaaacagctctgcggtgatctcacgctttttcgccgcatcctcaatgttattgatgctgtgcagaatacccagcccctctttggcaatttgccagtggcaggcgggtacgcgcttaacctgtcgcggataacgctggttaatcgcatgcagcatctcaaggattttcatgtagtgccgagccgagcgcatacgggtgtcgtcggtgcccggagtatgggacacggaagccgaatgaatcaggtagtcgtaataggtttcgtcgatgtactgcacacgtttcgcggtcagcagcacttccgttgtccagggaatatcctgatggcgcagaccatgctcgaaggtaaaaccctgcgctttgataaaagcatggcgatagatgttcagccaggtcacatgcaggaatttacgtgacgacagcgctttttgcagccaggtcggcccatccagcacgcccgttgagggcagcttatcggacgggaaaatcttcttcgccgggcggccatcatcgtaaatgtaggtgccattacaggttgccacatccagatcgccctttctggctatttccagcaggcgggtatacatccccggatagatcacatcgtcaatatccggaaacgcaatgtactcacctcgggcaaccgccagcccggtattgcgtgccgctgaaaccccctgattgggctgatcgataacctgataatcgctgaattcatcggcgtagcgggcaatgatcgccgcagaattatcggtcgaaccgtcgtttacgataatcaattcgaggctgttcaggttctgacttttgatgctgtcaaaaaaagcgctcagaaacttttcaccattatagacggcgacaacgaggctcaattgcggggtatctgacatgctttctccgtaaaagcgggcaatgcggtggcttttcgacagccattatctgaatgagttctgccggggtatggcagcaccagcggtggctattatctactaagtgataaagaaaaccactggtgcaggaacattaccatcaggaagtgggctgtttctcattgcgcggcgtcaacgagcagatgccgataagcaggccggtgagcatcatatattgctcaaggtagtgatccttaaggttatgatcgaccagcgtacgtgagaagaagcctaccgtgaacagcagcaggaacatgcctgccatggtgttgccgcggcggaactgccgccatccgatataccagcagcccatcagcaaaatcagccagcccgcaatccccgcaatgccgttttgcagaccaaattcgattaagccgtagtggctgtgcggaacagtaatgaaatcggaacccgtatcgcgacgcaggatgtaattaaaggcctctttacgcgggcccatgcctgccgggtgctcggctatgatcttccagcctgtgtgaaagaaactggcgcggcagccattagaatgattcatctggacgccaaggctatttttgggcacaacaccaatgacattgttgtagcaaaaactgtttaacggcgcattccatccggcaatggcatcactctcaagcgtttgccagcgcggatcggttttccatgaggcataacctaatgtcaaagaggcggcgataaatagcactaatatagtgcccatcagcacgactttactacggcgcatatgatgcacaccaagcagaacaaaggttgaaaacaggctgcccactagcccaatggttccccatcgcgtatctataagggcggtacaaaccaggttagacaataaaatcgctaccagtactggtgtgttcagacgcaggaaacgctggtgtagtaaacctcgggccagcaactcggcaatcagaaaaccggtgatcatattcacctggaagctcatacgggtgcggttaaagacgatccgtgtttccccccagtgaatatacccatcacgccagtacagccagagggtatccagcagatggatacagatgacgccccagaagaataaaacgatcagcgtaaacagacgggccgcggaaaagttggggaaggcggtttgtatggcaggtaacatgaccataccggcacagaatagcaggaccggtcgtaaccactggccgctccacgccgaaaccatttctttaatatcgggagtgacaacaaagccattaatcagaataaagaaagttaatacccagacggcaataagaacaaacttaatctgtctgaaatttaaacgggtgcgggcttcaggtgaagaaaagaaaaggccaacagataaagcaattaaaggataaatcaggccatttcgatgaaacggtaattgatcgttaggaatcggccaggcgaagcataatgctaatgtatagagaactaacaggcctgtcaggatgttacgagttttcgtcataattatttaggctagttaaggatttcggcgtggtgaccgggtagtaacgcagcagcacaagaattccacgacagggcggagagatttgtgaaagcgcaggaaaattaccatagatagcacaacttaagaagaataatgtttgtaagtaagattatcactgagcgggcgatgaatgtgcgtcaggcgggcctgcaagtatataatgattcgattaatgaggtcgttagccactcacaggaagcgtatgcatattgttcacacagaagccgatggcggtaagggcggtcagccattgcgcatcatcaatgagtcactgggtatgatccagcgtggtcatcaggtgaccattctttgtccggagagcgcgccgctgcatgcgctggcgcagaatgccgggctgacggtggtgacgcttccgctcaggcggaaaaatgtgccgaacctgctggcgttacgccgctggctgcaggccaaccggcagactgtggacgtggtcaatagccataactcagccgatacctggctggtggcgctggcgaacctgacgctctcacgcccggtgccgctggtgcgcacccgtcatgcatccggtttaccgcgcaataatgccggcagccgctggctgttccgcaccgcctgcgcgcatatcgtcaccacgggcgaagcgctgcggcatcagatgacggcgattggcgtgccgctggaacaaaccacctccgtacccagcggcgtcgatccggcacgttttcatccggcggataaacaggcggcgcgccagcagtgcggtctgtcggcggatgatttctggctcggcgtggtgtcgcacctgcgccccaacaaaggccacagcgtgttgctggaggcgctggcgcagatctctgatccaacgatcaagctggcgattgtcggcgaaggtccacaccgtgcggcgctggagcaggaaatcgtacggttgggcttgaccgatcgcgtgctgatggcggggcatcaggctgcgccggagaagtggttcccggcgtttgatattgcgttaagcccgtcccacgatatggaaggcgtgccgcagggcgtactgcaatccctcgccagccgcattgccaccattgccaccgacgcgggcggtacggcggatgcggtgattgaccgccagactggcctgctggtcggccagcgtgatgccggggcgctgcgtgatgcgattgtcacgctgcacaaagatgctgcgcttcgcgaccagctggcgcagcaggggtatgattatcttctcgcccatctcacgcgggactgtatgttaagcgcgatggaaaaggttttttccgacgcgattcagcgtaacagctcgcgataaagcgcctgtaactcctgcgccatgcggtcgagcgtccagggctcggcggtggtgcgggcatttatggcgtacgcttttcccgcctcgcgacccgacagccattcgccgatagcctgccggtagccggaaacgtccagcgcatcgcgcacccagccgttttccccttcgcggatccattccgccgccccgcatccggggctggtaaacagcggtaatccgcaggccagcgcttccacgcagacatttggaaagggatcgtaaagggtaggcaggatcagcgcatccgccgtgccgtagacctggcgcacatccgccaccgggccgagaaattttacccgatccgccacgcccagcgactgcgcctgcttttcaaatttacgggcatttttatcgcgtccggcgaccagcagccagacgccgggatgcgccgcgatggccgccagcgctgtcgccacgcctttacgcgcaaagccggaaccgacgtaggccagcaccggcgcatcggctgggatcgccagcgtctcccgcatcgtcagcctgcgcacgtccggatggaaatgggcggtatcgacgccgttataaatcaccgtcagcctgtcagcgggcagacggaagcgacgaacaatgtcatcccgtaccatcttagagttgcagatcactttgcgcagcgccggatgggtgaacatcgcctgctccgcctgcaaaatgtagcggtgataggggctgaaggactgcgaccagcgcttcggcagcgacagaatgcggctgtactgttcaagccaggtggcgtgcacgccgtcaccggcgcggaaaatggtggcgccgggaatacgctcgtggctctgcacaatgtcgaagcggttaaacagctgagacgccgcgcgggcaaagccagcttcccgggcggtgcggttacggaagggcggatcgacggtcagcgtctgccagccggtggcgttctcccactggcgggcgatcagcgtgacgtccagcgaactgtcgcccgccagggtattcagggcgcgggaaacaaaccgctccgcgccgccgttggggttataggtctgtcggacaatcgccagtttcatgccggattttccagtagcagcgtatcaatggcgctcagcacctgctgtggcgtaatggcggtgatgcagtccgacacgccgctgtcgccgcagcctgctttcccgcagggctggcaggtaaagcccgcaataatcacccggtaggccacgccccagggtgcccacttaatcgctccggtcgggccaaaaatggccaccgtcggcgttcccacggcgctggccagatgcatcggcatcgagtcgacgccaaagtagagccgcgcatgtttcatcagcgcgcccagctctttcagattcagctgtccgctgagatcgaacaccggctgcgtcagcgcagcgcgcagctgatccatataggcggtttcttctttcgaaggtgcagcggagaggatcaccggaatgccgcgtgcggcaatggcatccacggtggccgccagcttgtcaatctgccaggccttgaacatccagcgtgaggtgggatgcaccagcacataatctttccccaccaggccaaaccccgccagcttgttcagcacggaggtttccgcgtcctcgcccggcacgaacagcgtgcgtttgtcttccacgctcgccggatggatgccaatgcggcggagcgcgtcgaggttcacttccaccatgtgacggctgttgtcctggatcgccggatagagcgtggtaaaagatttcacccagcgccagcgcgccagcccgctacgtttatccggcttaaagccgacggaaacgcgcggcttcagcttgcgtgccagccgtgcgccgtgccagtgctcggtcaggttgattagcacgtcataatcccgcgctttcagggtgttacgcagctggcgatacaggctcagctgcttcagccagccctgtttacgccagttacgcccgatggtgtgcacctgatcgatataggggtggctggtgagcatcgcctgcgtatcgtcatagaccagcgcgtccacttccacgcccggccagttttttttcagcacggtaaacagcggcgaggttaaaagcacatcaccatgatgacgaagcttgatgatcagtacccgtttcggcgggcgttcagccgtgaaaaagtcagacatggacattctctgttgccagcaagggctgtaatttttccaggaccgcagcggcggggagatcgcttaactgcgatgaatgttcagggcggcaaacgacctgatttttgccataaccgccaattaatcccggatcggtcgggccatataacgtgatattaggacgatcaagggcggcggtcagatggcttaatccggtgtccaccgacaccacaaaggcagcgcctgccagttcgcgcgccaccttttccagactcatgcgcggcagtacctcaacgtgatccatatcctgcgtcagccgttttgcgcgcgcttcttcgtgggcggctccccagggcagcttgatgcgcagtccggtgggctgcaacaaggcgatcagctcgcgccagtgggactcaggccagtgcttatcatcgcgggtagtggcatgcaggaacacggcgtaagaagcaggttgcgtctggtcggtcaggaagtgctgcgcaatgccgtaatcgccctgggtttgcggtcgggcataacccagactacgggcgaacagctcgcgggtgcgttccaccgcgtgctgcgctttggcgatggcatggcgacggttataaaacaggctcgccagcggctcgcgggcgctgtgccagtccataccatgcttcacgccgcgcgccaggcgcgtcaccagcgctgcgcttttcaccaggccctgcgcatcaataatagcgtcgtattgtacagcgcggatggcgtcacgaaatttctgccgttcgacgcggatcggcgcggaaaaccacgccttacgccagcggcggatcgccaccgggatcacgcgatcgacggcggcatgccagccggggatctgcgcgaagccctcttccaccacccagtcaaaacgaatgccaggaatagcctgcatggcgtcggttaacgcgggcagcgtatgcagcacatcgcccatcgacgaggtttttacgatcagaacccgcatccgttacccttcttccgccagcagtaaagcattaagttcattaagcacccgctcaggcgtaatgtcgatcaggctctggtgatagccctgctcgctgtcgcctttgcggactttgtgatagccggtgatcagacgaataacccgggctttatgcgacagcggcggggtaaaatcggggctgctggggccgtacagcgccaccagcgggcgattcagggccgcggcgacgtgcatcaggccggagtcattcgtcaccacggctttacaggcggcgagtaaaatcactgcctgctccagctgagtttcaccggcgaggttgcggcaccaggcctgctgctcaatgctcagggcggcgaggatctcattaccggcgtcgtgatctttcgccgatccgaacagcaccacctgataaccttcgtcgatcagctgcttagccagctctgcgtaatggtagtgcggccagcgttttgccgggccgaattccgcgccggggcaaaagccgatcaggggacgttcagcggagaggccaaacgcatcacaggtccgggctttttccgcctccgtaacctgcaactgcggccacagcagcggctgcggcagatctttcgccgactgcatcacgcctttgtcccaggccagggccacatagcgttccaccatcagcggccaggcttgtttatccagcacgcgggcgtcgttgagcacgccataacgcatttcaccgcgccagccggtacggtgcgggatgcccgcaaagaacggcaccagcgcggatttaaaggagttcggcaggacgtaagcgcgatcgtaacgtcgctcacgcaggctgtgcccgagcctgcgccgctcgccaagctcaagcgcgccgtgccccagcggcatggcaatcgcctcgttgacttccggcatgcgcgacaataacggacggcaccacgcgggtgccatcacgtcaataatcgcctggggatagcgcgccctgagcgtgcgatagagactttgcgacatcatcatgtcgcccacccatgacgggcctaccacaaggatcttcatcgtcaggcgtcgcggttcagccaggccatatactccgtcacgccttcggccacggttttgaacggtttatcgtagcctgcggcgcgcaggttagtgagatccgcctgggtgaacgcctggtagcggcctttcagtttttccgggaacggaatgtactcaatgctgccttttttgtggaacgccagggtcgcatcggctaccgcctggaaggactctgcacggccggtgccaaggttgaaaataccggacacgccgttttcccagaaccacaggttgaccgccgccacgtcgcccacgtagacgaaatcgcgcttaaagttttcgctgccttcgaacagcttaggcgtttcgccattgttcaactgggtgttgagatggaaggcgacgctcgccatgctgcctttgtggccttcgcgtgggccataaacgttgaagtagcggaaaccgacaatcggggacgtcgcttccggcaggatttgacgcacatattcatcgaataaaaacttggagtagccgtagacgttcagcggcttctcatattcgcgggattcaataaagtcagaggtacggccgccgtaggtcgccgcagaagaggcatacaggaacggaatgttgcgctccaggcagtagtgcagcacctctttagagtactgatagttgttatccatcatgtacttaccgtcccactcggtagtggacgagcaggcaccttcatggaaaatcgcctcgatatcgccgaactcttcccccgccatcacctggatcaggaagtcttctttatccatatagtcggcgatattcagatccaccaggtttacaaacttggtgccatctttcaggttatccacgaccagaatgtcagtgatgcccttgtcattcagcgctttaacgatgttgctgccgataaagcctgcgccgccggtaacgataatcataactgtgacctttgaattgaggcgcgccgggacaatcccggacacgaatatttcttatcataccatcacattgcagacccttcagccattcaccgccaaccttcccgacgacacgtgatttatgctgcaaaatgaacaatggatgatgcgtcatctcgtatcaacgtatagctttgggtaatatgtgccgaaatttgtccagtctggagaattgcaatgcgtggggatttttacaaacagttaagccatgacctggaaaccgcgcgtgcggaagggttgtttaaagaagaacggatcatcacttcggcgcagcaggcggacattaccgtcggcgacggcagccaggtgatcaacttttgcgccaacaactatctgggcctggcgaaccacccggatctgatcgcggccgccaaagcgggcatggattcacatggtttcggcatggcgtcggtgcgttttatttgcgggacgcaggacagccataaagtgctggagcagaagctggctgaatttctcggcatggaagatgcgatcctgtactcctcctgtttcgacgccaacggcggtctgtttgaaaccctgctgggcgcggaagacgccattatttccgacgcgctgaaccacgcctcgatcattgatggtgtgcgcctgtgtaaagcgaagcgtttccgttacgccaataacgatatgcaggagctggaagcgcgtctgaaagaagcccgcgacggcggcgcgcgtcacgtgctgatcgccaccgacggcgtgttctcaatggacggcgtgatcgccaacctgaaaggcgtgtgcgacctggcggacaaatacgatgcgctggtgatggtggatgattcccacgcggtaggctttgtcggtgaaaatggccgcggcacccatgagtattgcgatgtgatgagccgtgtcgacatcattaccggcaccctcggtaaagccctcggcggcgcatccggcggttatacggcggcacgcaaagaagtggtggaatggctgcgtcagcgctcccgtccgtatctgttctccaactcgctggccccggcgattgtcgccgcctccatcaaagtgctggagatgctggcggaaggcagcgagctgcgtaaccgtctgtggactaacgcgcgcctgttccgcgaaaaaatgaccgccgcaggttttacgctggcgggggccgatcacgccatcatcccggtgatgctgggtgacgccgttgtcgcgcaaaactttgcccgcgaactgcaaaaagaaggcatttacgtcaccggcttcttcttcccggtggtgccaaaaggtcaggcgcgtattcgcacccagatgtcggcggcgcatacccctgagcaaatcgaacgtgcggtggaagcctttacccgcatcggtaaaaaacttggcgtgattgcctgaggacctgtaatgaaagccttatccaagctgaagccagcggaagggatctggatgaccgatgtaccgcagccggacgtcggacataatgatctgctgattaaaatccgtaaaaccgcaatttgcggcacggatgtgcatatttataactgggacgaatggtcacagaagacgatcccggtacctatggtcgtgggccatgagtatgtcggcgaggtggtcggcatcggtcaggaagtgaaaggctttaaaatcggcgatcgcgtttccggcgaagggcatatcacctgtggtcattgccgtaactgccgcggtggtcgtacgcatctgtgccgtaacactatcggcgtgggcgtcaaccgtcagggctgctttgctgaatatctggtgatcccggcgtttaacgccttcaaaatcccggacaatatctccgatgaactggcgtctattttcgatccgttcggcaacgcagtgcatacggcgctctctttcgatctggtgggcgaagatgtgctggtgtccggcgcaggcccgattggcatcatggcggcggcggtggcgaaacacgtcggcgcgcgccatgtcgtcatcaccgatgtgaatgaataccgtctggatctggcgcgtaaaatgggcgttacccgcgcggtcaacgttgccaaagagagcctgaatgacgtgatggccgagctgggcatgaccgaaggttttgacgtgggtctggagatgtccggcgcgccggcggcgttccgcaccatgctcgacaccatgaaccacggcgggcgtattgcgctgctgggtataccgccgtcagagatgtccatcgactggaataaagtgatctttaaaggcctgttcattaaaggcatttacggtcgtgagatgttcgaaacctggtacaaaatggcggcgctcatccagtctggtctggatttaacaccgatcatcactcatcgcttccccattgacgcgttccaggaaggcttcgacgccatgcgttccggccagtcaggaaaagtcattctgagctgggattaaataaaaggcaccttcgggtgcctttttagccccatcacatctttctgcatttttaatagcgaaagcatgatttctttatcaccttttttaatatccggttataacatgcattgacgatcctattaacaggtgcgattgactgtatgttcaccttatccgtgtgtctgctgacctgtaattcagcgcgattattacgtgaggttctgccgcccgttttagcggtggcggatgaaattattgtcgtggattccgggagcagcgatgccaccctggatatatgtcatgaatatgaactggttattcaccaccacccttacactatgcatggcgcgcagatgaactatgccatcagtctggcgaccaatgactgggtgttatgtctggacagcgatgaagtgctggatcccgaaaccattgattttattttacgtctgaaagcgggagagacgcctccccctgaccaggcgtggcggctttcccgttactggtatgtgctgggggaagaagtgcgaaccctttatccggtgtcgtcccccgattttccggtgcgattattcaaccgtcagcatgcgcgttttaacgatcgaccggtggacgataaagtcgaaggctttagcacttcggtaaaaattcccggacgcgtgcgccacgataccttttattctttgcatgaagttttcaacaaactcaacagctatacctcgcggctggtgaaatatcagcaggtgaaaccgtcaatcgggcgcggcataataagcgccataggcgcgttttttaaatggtatctgtttagcggggcatggcgtagcgggaaagtcggggtggtaaccggtttatatgccacgctttatagttttctgaaatatttcaaagcctggtatattcatcaggatgaaaaggcggcgttgccgaaaacgcaaaaaaatcgccgcctgatctgatcatcagcccgcctgctggcgggctttgccccatccctgccactggccctgcacgtatttcaccagcggactctcgctgatgctttcgctcagcacgctaaagaaacgcgtcgcatcaacgcgctcaggggctgtcttcggtttacacaacttcacgccgcggaacgggttgcgcggtgcctgcggttggctggcgggcggcgtcagcacaggttttgaggtgtcgatctgcggctcgttcagcaggctgcccggacgcaccagcgtgatatccggcggcaaagtgggcagcatttgttgcaggacgcgcactgttgacgggtgcgggtggccgatggcgatcgccgagccgttacgccgcgccagttctaccgcgcggttaaactggcggcgaatatcggcttcgttctgggtatcgtcgaggaacactttacgcttgatcaccttcacgccggtgcccgtcgccgcgcgcattgcctggctgttgccgatggtcatactgtcgagaaaatagagatcgtaacgcgccagcgcctgcatcaccttctgcatgccgaacaggctggaggtcatggcgctgcccatatggttattcagcccgacggcatagggcacactgtctaccgcattgcggatgatgcgctcgatttcatcgctgctcatgtccgggcgcagggtgtctttttccagcggctgtttgctgagcggggccatcggcaggtgaatcagcacttcgtggcccagattatgcgctttggtcgccatttcccgcgcatgaggcgcattgggcagcacggcaacagagatggcggcaggcatcgccagcacctgattttcgttgtgcggacgataaccaaaatcatcgatcacgatggcgagttttccggcaaacgccggggcggtgaaaaccagaacgctgacaacagcaacaatcagacgacgaaattgaagcaaaacttatcttcccaaccacggttgtggattgaccgcctgaccctggcggcgaatttcgaaatagagtgaaggtctgccctgaccgccactgctgcccacaagggcaatcggttgaccggcacgcacctgcgtgcccacgctgaccagcgcgctctgattatagccgtaaagactcatgtcgcctttaccgtgttcaaccaccaccacaagaccatagccctgcagccagtcggcgaggatcacacggccatcggcaatggcttttacttcgctgccttcagaggcgccgatcacaattcctttccaccgtagctcaccctgtaactgttcgccataacgatgcaggatagtgccccgtgccggccagtaggcctggccgcgtggcgatccgaggccgccggtgcgggacatcagcgactgttcgctttccgtcggcttataggtggtgcctttgcgcgaggcgtctttctggcgatcgcgcaccgcctgggcttcgcgcgcttcacgttccgcccgcgctctggcggcggcttcggcgcgggcaagggtattgcgcagccgtgattcgttagcccgcagttcgctcagctgttgctggccctgctggatggacgactccaggcctgcgagggttttcttacgctcgttgcgcgcctgctcaagcttagcctgctgtgcctgctgctcataaagcagggtttgctgctggctctgcttctcttccagctcggctttctgagagttcacttcttcacgggtttgctggagctgggcgatggtttcctgacgcgcctgattcagatagccgtaataggcctgcagacgctgcgatcgctggccttcttcgccgctgaggatcatctgtatcccgctgtgttcgccctgacggaatgccgcatcaagctgcgcggccagattacgctcctggctggcgcgctggcgctccagtctggcgatagatgcattcatctcatcaatttgtttattgagctggccgagagtgttctgggtttcgcgcagagcgcgggtggcggcagagatcgcctcttcctgcgcttttaactgggcgaggagagtgctgcgctgctgctgttgcttacgaacggcacgttctttggcggcaatgtctgcctgaatggattttaactggtcgcggtcatccgcgtgggctgaaaaggcgcacaacaatacgccagcgctgagcgcgctggcgtagatcacggaccggatcgacacagtccaggtgtttgaaaaaatcgcctttcccctcatggggagcgattattccacgatgaacagcggcttaccagtcatctcttgcgggatttccatgcccatcagcgccagcatggtcggcgcgatgtcggaaagtttgccgccatccaccgctttcacggttttgtcgcccacatagatcagcggcaccggcaggttagtgtgggcagtatgcgcctggccggtggccgggtcgcgcatctgctcagcattgccgtgatccgcggtaatcagcagctggccgcccacggactccaccgcctcgctgacctgcgcgatgcagttatccagggtttcgacagcggcaaccgccgcttcaaagacgccggtatgtcctaccatatcgccgttcgggtagttgcagatgatggcgtcatacttgccgctgttgatcgctgcgaccagtttttcagttaattctgcactgctcatttccggctgcaggtcgtaagtcgccacttttggggagttgatcagaatgcgatcttcgccggcaaacgactcttcaacgccgccgttaaagaagaaggtcacatgggcgtatttctcggtttcggaaatgcgcagctgggttttgtcatgcttcgccatccactcgccgaaggtattcgccagggacgccggtgcgtaagccaccgtcgttttgatatcggcggcgtattcggtcagcatgacgaaatcgcttaactgcaccactttctgacgggcgaagccgtcaaaatcggcattcacaaaggcgcgggtaatttcgcgggcgcggtcggcacggaagttcatgaaaatcagcgcatcgccgtcgaccatcgcggagtcggcctggccttcggcgcggatcaccgtcgcttttacgaattcgtcgttttcatcacgggcataggctgcctgtaaacctgcgaccgcgctgtcggcctggaactcgcctttcgcctgcgtcagcaggttgtatgcctgttccacgcgatcccagcggttatcgcggtccatcgcatagtagcgaccaataatagtggcgacgcggcctttgcccagttcagcaaatttgtcttcgaagcgtttcagggacgattctgcgctgcgtggcggggtatcgcggccatccaggaaagcatgcagatagattttttctgcgccgcgctgagctgccagttcgaccatcgcaagaatgtgatcttcatggctgtgcacgccgcccgcagacagcaagcccatgatgtgcacggctttgccgctggtggtggcgttatccaccgcagcggtcagcgccgggttgctgaaaaaggtgccctgtttgatttctacgtccagacgggtcagatcctgataaacgatacggcccgcgcccagattgacgtgaccgacttccgagttgcccatctggcggtccggcagacccacttccaggccggatgcgtcaatcagcgtatgcggacgtttcgcccacagggcatccatgaccggcgttttagcgttaaaaatagcgttatcctgctggtcttcacgatagccatagccatcgaggatcaccagtaccataggttttttagaaaccgacattgcgacaacctcatgctcatgagtcaaaaatttgcgtaattttactacagctgaatcgatcaaatagccgcagaagatcaaagaatgaggtggggaagggctgtgtttttaatggcttcaggcatttttttcgtaacgcgccgcagaaaatgcattccgttgtgctcgctggctgtatttgctacaccgcacaggtatactcctttcctggtttttaatcattgagtcgggagttgttgccctccatgcaagaaattatgcaatttgttagccgtcaccccatactttgtatcgcatgggttgtcttactggcggcggtgctgttcaccaccttcaagggtctggtgtcgaaagttaaagtcatcacgcgtggtgaagcaacgcgtctgatcaacaaagaagatgcggtggttgtggatctgcgccagcgtgatgatttccgcaaaggccacatcgcgggcgcgcacaacgtgctgcctaacgatatcaaaaacaataacctcggcgagcttgagaaaaataaaagcaaacccattattgtggtagatggtgccggtatgcaggcccaggctccggcgaacgagctgattaaagcgggcttcgaacgagtctatgtactgaaagatggcgtagctggctggagtggtgaaaacctcccgcttgttcgcggtaaataaatcataagtggagtgctgtcatggccaacattgaaatctataccaaagcgatctgcccgttttgccatcgcgcaaaagcattgctcaacagcaaaggcgttgccttcgaagagctgccgattgatggcgatgcggtgaagcgcgaagagatgattcaacgtagtggccgtacgaccgtgccgcagatttttattgatgcacagcacattggcggctgtgacgacttgtatgcgctggacgcgcgtggtggactcgatcccctgttacgctagagcgtatttaggacaacactaaggactactcatgtcagaacaaaataacaccgaaatggctttccagatccagcgtatttataccaaggatgtgtctttcgaagcgccaaacgcgccgcacgttttccagaaagactggcagccggaagtgaaactggatctggatacagcttccagccagctcgctgaagacgtttatgaagtggtgctgcgcgtcaccgtgaccgcaagcctgggcgaagaaacggccttcctgtgcgaagtccagcaggctggtatcttctccgttggcggtatcgaaggtacccagatggcgcattgcttaggcgcatactgcccgaacattctgttcccgtatgcccgtgaatgcatcaccagcctggtttcccgcggtacattcccgcagctgaaccttgcaccggtcaacttcgatgcgctgttcatgaactatttgcagcagcaggcaggcgaaggtaccgaacaacctcaggatgcctgatgagtacgataaatgctcatatgactgtgatcggtgccggctcttacggcaccgctcttgccattaccctggcaagaaatggccacgaagtggtgctttggggccacgatccaaaacatatcgcgacactgcaacacgaccgttgcaatgtggcgttcctcccggatgtgcctttccccgatacgctgcaccttgagagcgacttagcgacggcgcttgccgcgagccgcaatattctggtggtggtgccaagccatgtttttggtgacgtgctgcgacaaatcaaaccattgatgcgcgacgacgcgcgcgtggtatgggcgaccaaaggcttagaagctgaaacgggccgtctgttgcaggatgtggcgcgtgaagcgctgggcgatgccattccgctggcggtaatttccgggccgaccttcgccaaagaactggcggcgggcctgccgacggccatttcacttgcctccaccgacgaggttttcgctgaagatttgcagcagttgctgcactgcggcaaaagcttccgtgtctacagcaacccggattttatcggcgtgcagctgggcggcgcggtgaaaaacgtcattgctattggcgcgggcatgtccgatggcatcggttttggcgcgaatgcgcgtacggcgctgatcacccgtggtctgacggaaatgtcccgtctgggcgcggcgctgggcgccgatccgtccacctttatgggcatggcgggactgggcgatctggtcttaacctgcaccgacaaccagtcccgtaaccgtcgtttcgggatggcgttaggtcagggcatggacgtaaaaagcgcgcaggagagcatcgggcaggtcgtggaaggttaccgcaataccaaagaagtccgcgagctggcacaccgctttggtgtcgaaatgccaataaccgaggaaatttatcaggtattgtattgcggaaaaaatgcgcgcgaggcagcattgaccttattaggccgctcccgcaaggatgagcgtaccagccatccggctccctaatcctcatcactgacacggccatcgcagagtggccggtcattttatttcgcctggagtatgcaatgccgtgtgaagaactggatctcgtctggaataatattaaagccgaagcccgggcgctggccgattgtgagccaatgctggccagtttttatcacgcaaccttactcaagcacgaaaacctcggcagcgcgctgagctatatgctggcgaacaaactcgcgtcgccaatcatgcccgccatcgccattcgtgaagtggtggaagaagcctacgctgccgacccggaaatgatcgcctccgccgcctgcgatattcaggcggtgcgcacccgcgatccggcggtggataaatactccacgccgctgctctacctgaaaggttttcacgccctgcagtcttaccgcatcggtcactggctgtggaatcagggccgccgcgcgctggcgattttcctgcaaaatcaggtgtcggtgtccttccaggtagatattcacccggcggcgaagattggccgcggtatcatgctcgaccatgccaccggcattgtggtgggggaaacggcagtggtggaagacgacgtttcgattttgcagtcggtcacgctcggcgggaccggcaaaaccagcggcgatcgccatccgaagatccgtgaaggcgtaatgattggcgccggggctaaagttctcggcaatatcgaagtcgggcgcggcgcgaagattggcgcgggttcggtggtgctgcaaccggtgccgccgcacaccacagtggcgggcgtaccggcccgcattgtcggcaagccggagtcagacaaacccgcgatggatatggatcagcattttaacggcgcgaatcaccgcttcgagtacggcgacggtatttaacgctagctgcgcagtaccgcgcccggatagccaagctgacgccaggcctcgtacaccacgaccgacacggcattagacaggttcatgctgcggctgtccggcatcatcgggatgcggatcttctgctctttgggcagcgcgtccagaatggcggcaggcagaccgcgtgtctccggaccaaacatcagataatccccgtcctgataactcaccgcgctgtgggctggcgtgcctttggtggtcaaagcaaacagccgctgcggattttccgctgccacaaaagcggcgtagtcagcgtgacgcaccaccgcggtaaattcatgataatccagcccggcgcggcgcagacgcttatcatcccaggtaaaacccataggttcgataatatgcaggcgaaaaccggtgttggcgcacaggcggataatgttcccggtgttcggcgggatttcaggttcgaataaaacaatgttcagcatgctgccccctcaataatggcgggcagcatagcaaaaatcaggcggcatcgcctgttttcaccggcgcaaacaccgattcatgctcaacgttctgcaccagcgagtcgcggctgatttcgctgatagaacgcgccccggttagcgtcatcgccacgcgcatctctttttcgatcaggttaagcaggttcgccacgcccgcctggccgtgggtcgccagcgcatacagataggcacggcccagcagcacggtatccgcgcccagggcgatcatccgtacgacgtccagcccgttacggatgccactgtctgcgaggatcgcgatgtcacctttcaccgcatcggcaatggcgggcagcgcgcgggcggaagagagcacgccgtccagctggcggccgccgtggttcgataccacaatgccgtctgcgccaaagcgcaccgcatcgcgcgcatcttctgcatcgaggatccctttgatcaccatcgggccgtcccagtattcgcggatccactccaggtctttccaggaaatcgatggatcgaagttattcgccagccagccaatataatcttccagcccggtcggcttgccgaggtaggtggagatgttgcccagatcgtgaggacggccattgacgccgacatcccacgcccactgaggatgcgttaccgcctgccagtaacggcgcatcgccgcgttggcgccgctcatgccggaatgggcgtcccggtaacgcgcgcctggcgtcggcatatccacggtaaacaccagcgttgaacatcctgccgctttggcgcgctccagcgcgttacgcataaagccgcgatcgcgcagcacgtacaactggaaccacatcggacgcttaatcgtcggagcgacctcttcaatcgggcagacggataccgtcgacagggtgaaagggatgcctttcgcatcggcagccgctgccgcctgcacttcgccgcgccgcgcgtacatgccgcacagcccgaccggagccagcgccaccggcatcgacagtttttcattaaacagcgtggtttccagactcaaatcggacatgtttttcagaacgcgctggcgcagcgcgacctgcgagagatcttccacgttacggcgcagcgtatattccgcgtacgcgccgccgtcgatgtaatggaaaagaaagggtggcaggatgcgctgcgcggtggcgcggtaatcactggcggcggaaataatcatgggtttctccctgacagtttattgggttaaccgggcaggcgggtgatgcgcgcctggcgggcctgatcttcatcgaatcgtttaatggtggtatgcacaaattccagatgcagcatcatcgctttacgcgcgccgtcggcgtcaccggccataatcgcgttcatcaccgcctgatgctgttcggtgagctgcgcgaacaccggcggcacgaaatacatccgctggcggctctgtttcactgacagttgcagcagatcgaaaaagccgcgcatggtctgcaacagcaccacattgtgcgacgcttcagcgatggctaagtgaaagcgcacatccgcctgcgaagcgagatccgggtcatcgctcagggtggcgtcaaagcagagctgaattttttctttatccgcagcggtggcgcgcagggcggcgtgccaggcggtactggcttcaatggcatggcgggcttccagaatatcgaagctgtagtccggatcgtctgccatcagggttttcagcggataaacaatattttgctctgtccagtcttcctgcggccagcgcacaaaggtgccgccgccgcgtcggctgagcagcacgccttcgctgatcaacttcgcaatcgcctcccgcagagaattgcgggagacgccaagctgggcggccagcttgcgctcggcgggcaaacgcgcccccggctcaagctgctgttcgtctatcagcgcacgcaagcgatcggcgatggtgtcggacagacgcacgggcatcactatcatgggatcatccaggtcagaacgtatgcctgaagtgtagtgatcactcccaccatgcaggtgaaaatcaggctgtgtttaacggtaaagcggaacagatcggactctttacccaccagccccaccgccgcgcaggcgatggcgatagactgcggcgagatcatcttgccggtcacgccgccggtggtattcgccgccaccagcagcacatccgagacgccaatttgctgggcggcggtcgcctgcagggcggcaaagagcgcgttcgaggaggtgtcggagccggtcaggaatacccccagccagccgaggaacggcgagaaaaaggtaaacgcatgaccggtatgggaaagcgccagcgccagcgtcgaggacagcccggaataattagagataaaggcgaacgccagcaccatgccaatggagtagatcggcagcgccagctctttcagcgtgctgccgaaggtgtagagcgcctctttcggcttcatacgcagccagacgatggagatcagcgccgcgaacagaatggccgtgccggtggcggagaaccagtcgaacttatataccgccgcataaggcgtggccgcgctcactaccggcggcatacgcgccaccagcttatccagatacggcacggagatattaatcacccagtcgtacatcgcgccgccaggggcaaacagcgctttaaacggcggaatgctccacagggtgacggtggcggtcagaaacaggaacggcgaccaggcgcgtatgatttgcccgcgggagtaggatttcggcgtaacggcggcatcattcgcagtggcattcacatcttcaaagcggaagatgcgcaccggctgccagcggcgcaggaacagcgtcaggcacaccagcgaaaccagcgaggagataatgtccggcagttccggcccgagaaagttagagctgaggtactgggcgatggcaaaggagccgcccgccacgatcaccgcaggccaggtttccttcacgccgcgccagccgtccataatcgccatgatccagaacagcacgatgatggtcaggaacggcagctgacggcccaccatctggccgatttcaaagctgtcgaggccggttacctggcctgccacgagaatgggaatacccatcgcgccaaacgccaccggcgcggtgttgacgatcaggcatagcccggcggcatacagtggtttaaagcccagccccaccagcagcgcagcggtaatggcgaccggcgcgccaaagcccgcggccccttccagaaaggccccgaacgagaagccgacgatcagcatttgcaggcgctggtccggcgtaatggagagaatggacgagcgaatgatctcaaactggccggttttgaccgagattttatagacaaagaccgccgcgacgatgatccacgcaatcggccacaggccatagaagaagccgtacaccaccgaggcgagggcgttatccaccggcatatcgtagaagaacagggcaacggccagcgcgatggcaaccgtccagctggcggcgacgtagcctttcagcttgagcttaattaaggcgaagaagaaaaacaggatcggtaacgaggcgataaggctcgacagccacagattccctgccggatcgtaattttgttgccagaggctcatgaagatctcctgagggccatttatcctgtcgcgcggcgagtctgcgctcgtctgcacgtcacactgtctgtaaaagtggccctgccagttaaggtttgtagggttaatgacaatgaatggttaactaaatgttattgactggcaatgcatgtgtgacaggaaatgatatatctgtgagcagaacaggactcaggggcaggattggtaggaccacatcagaagggaagcgcagataaaaacctctcccgcggacggggagaggtcagaaagcaggggatcagaattcggttttcgaaaagccggtcatctcggtcagcttcatttcgcgacctaattcggtcatcggatgcaccaccaccaggccgcgcacgcttttcttcagcttgcccatgtcggcctgttcttttttggtgatggcgcggcggaacggcatatccgccagtttctgcgcttctttgctcagcttatgcccgtgcagggcgcgcaaacgggcgatttcgccttccagcgtctctttttctttttccagctcggcgtatttgtcggcggcttcggccagcgaaatatcggcctgctggtggcggatagcgtcaaggcgatcgctcaggcgtttaatttcactcttttcaacttctttcatgacaattggactctgaatcggggagatattgcgctaaggatacactaaaccgcgggcggttacttctgaaaggcttttttcaggctgatgcgggagatcagctctgtcagggaaagcaccatggtggaacgtacaacctgttgataacgctgcttttgcatggcatagagatcggcatcgctgagatcaaactgcggcgcggggggcagggcggcgacgcagtgcagctcaccgaaggggcccaagatctcgtcgtcggtgaaagcgtattcgttgccgtcgtgattcagctcttcccgcagcgccatcagcagctcggcgtcctcgtattccggacggctgatgacgccaagcccgtaaatcagttttaagcgcaccgacaaatcgcccagcgggccgttgccgtccagcagcggctcaacggcatatttcaccgcgtaatcgtctttgcgaaaaacctgaagcaccagaatgttcaccgcctcggtcagtagctcgacggcggcgatcaaaaagctgcgtacggttttgcctgcattaagacgctcaagcacacggttttcaaaggcctgggtttcttccattattgcctgcatatccgacaatctgttgttcgggcgcggaaagctccgcgccgggtttggcatcatgcctttgcgttgtacgcgttaacggcctcggtcacgacgtcgctcgccgcgtccagcccggaaatctgcgccagagccgcctgcgggcctttctcttcaatcaactgcgccagctcaatggcctgcggatcctgctcgctgcgatagtgcatcgcggcggcaatacccagcaccaggttgtgatgcggcaggtcgtattccagcgtgcccagcagcggcttgatcaggcgatcgcccgcgctcagtttacgcagcggctgacggccaacgcgctccacatcatctttcagataggggttttcgaaacgacccaaaattttctggatataggcggcgtgtttctgcgtttcaaagccataacgtttgatcagcaccgcgccgctttccaccatcgcaccttttaccacagtacggattttctcgtcgagaatggcatcacggatagtctgcaaaccggcctgctggccgagataggcggtaatggcgtggccggtattcagggtgaagagcttacgctccacgaaggccatcaggttatcggtcagctccatgcccggaatattcggcagcgtgcctttgaactgggtctggtcgacgatccattcgctgaaggtttccacggtgacttccagcggatcgttggtagcggaggccgacggcggcacgatacggtctacagcggagtccacaaagccggtatgcgcttccacccaggctttatcctcttccgccagcgcgttgaacacgtggcctttcagctgcgtggtgccgcgcaccatgttttcacaggcgatgatattcagcggcgtgtcgttaccctgggctttacgttttgccagacctttggcgatggcaggagcaatgcgctccagcaccaccgggccaaccgccgtggtcaccagatccacctgcgcgatgagatcgatgacttcatcgccagtgctgttgaccgcgttaacgccggaaacggtgtccacctgctcattttcaccaacaacgtgaacctgatagctatgacgggcattcagggcatcgagcacggcctgattcacatcggcgaatgtcagctcaatacccgcgtccgccagcaatttgccgatgaaaccacgtccgatattacctgcgccaaaatgtaatgctttcatagaattaccttcatcaatgtttttacccgagagggctggggtgaggaggcgaattcccctcaccctaaccctctcccaatgggagaggggaaagggcgtaaccttacttgttcagcagggccagcacttcttcaacgctctgcgtgtgtgtcaggcgctcaatcacagattcgtcgtccagcgcgttagtcaggctggtgatcacctggatgtgctcgttgttacgggcggcgataccgataaccagacgggcaatgtcgtcggcatcatcaccgaagcgtacgccttccggatactgacagaataccacgccggtcttcagaacacggtctttcgcttcaaccgtaccgtgcggcacggcgatggactcacccagataggtcggggtcaatttttcgcgatccagcatcgcctgcacatactccggctcaacgtaaccgcctttcaccagctgctcaccggcaaaaataatggcttcttctttggtgctcgccgtgcggcccaggaagatgttttctgcgccgaggcggaacaggtggctgttactttcgtcgaagctgtcctgcaggctggtgcgcactttctcttcattttgctcgtggcgctgtgcggcaaccagacgttcagtcaggctggtgtacaggccgctgtcgaggaagttggtcagcgaaatatgctgcgcctgcggcacctggcgcatcgcacgctcggtcaggtcgcggtgcgtgatcaccaggtcaacatcgcccggcaggttgttgatcgcgctgttggtcacggagatgttagtcagccccgcatcctgcactttcttacgcagcacgcctgcgcccatggcgctggagcccataccggcatcacaggcgacgatgattttacgcacatggctcaggtcgttggacacttcgcccgcggtcagcggagaggcgcctttggactcggctttcatgtcctgcatgcgacgggttgcggcttcaatatcgtcgtcttctttcactttgctggttttcagcagaatggcggagatgacgaaagaaacggccagcgcagcgaaaatcgcggcgaggttagcaaaataggcacccttcggggtcatcgccagtaccgccaggatagaacccggagacgccggagacaccagaccaccgcccagcacgctcagcgtaaacacgccagtcataccgccgaggatcaccgcgatcagcagacgcggattcatcaggacatacgggaagtaaatttcgtggataccacccaggaagtggatgattgccgcgccgcccgcagactgtttcgcgctgccgcgaccaaagaacatatacgccagcagtacacccatacccggacccgggtttgcttcaatcaggaagaagatggacttgccgagatcgtgagattgctgaatacccagcggcgagaagataccgtggttgatggcgttgttgaggaacaggattttcgccggttcaacaaagatggacgccagcggcagcatgtcatggacgaccatgaagttaacgcccgcagccagtgctttagacagcacttcaaccgccgggccaatgccgaggaaggcaagaatggcgaggatcataccgatgatgccggcggagaagttattcaccagcatttcgaaaccggatttgatcttaccatctaccgcggcatcaaatttcttgatgcacagaccgcccagcggaccggcaatcatagcgccgaggaacatcggcatatctgcgcccacgataacgcccatggtggtgatagcaccgaccacgccgccacgctcaccgccaaccagacgaccaccggtataaccgatcagcagcggcagcagataagtaatcatcgggccgacgagtttcgccagcgtttcgttaggtaaccatcctgtcggaataaagagtgcagtaataataccccaggcgataaacgcgccgatgttgggcattaccatattgctaaggaatcgaccaaagctttgcaccttgatcttgatatcggatgacataaaacaccccttcttatgtttgctagcgcacaggccggaagcccgaggtttgttgttaatgtggcggcagaggtagccggacccatgatgtgtgtgaggcgaaatctggcaccgaatcgcctttctgtccagacagcgccctttggtgtgatctgaatcacataaacatagggtgtatccggggataaggcgtgatcaacttcacaaaacactggtgtaaaaaaagaacaccgccgaaaaaatcgacgcagaatggctgttaatgtgatgttaatcacatttgtatttcatgactttgttatttatttgtgatcttaatcacaagatatttttgtcaggagttttctgactgtgatcaaaggcaaactgtgatgtagacgcagacggcagatgtaacttccttacactgccgacaccttacggaacagacttttcacatttatgaaggcgcccctgccttttgcgcggcggtgggccataattatctcttcacaggcgattaaggacccggccatgaaactgattggcagctacaccagccccttcgtgcggaagatttccgtgatcttgctggaaaaaggcatcaccttcgaattcgtcaacgaaatgccctataacgcagagaatggcgtttcgcaatttaacccgcttggtaaagtgcccgcgctggtgactgacgacggtgaaacctggtttgattcccccattattgcggaatatctggaacagctgggtatggcgcctgcattgctgcccagcgatgcgaaagcggcattacgggtgcggcagctggaagcgctggcggacggcattatggatgcggcgctgacctccgtgcgcgagcaggcccgtccggcagcacagcagtcggaaagcgaactggtgcgccagcgggaaaaaatcagccgcgcgctggatgccctggaacaatacgccgccaacggcgtgttgcagtcgcagtccctcgatctggcgaacatcgctgtcgcctgcgcgattggttatctgaacttccgccgcgtgtcgccgggctggtgcgtggagcgcccgcagctggtgaagctggtggaaacgctcttccagcgcgaaagctttgcccgcaccgaaccgccaaaggcttgatacgcattatgacagcctgagcaaagacgctgtacaatcccctcacgtcgaccccttcccgacggaggggccaatcacagcaaggcagtgtcatgacccctgaaaatcgttccctgttcagccagatcccggcaaccgaccgtttattgcgtgatgatgccttccgcccgctgttagccacttttggccatacgcgggtggtggaggcgctgcgcctgttgcagaacgaggcccgcgccgccattcacgacagccagacgctgccggactggagcgctgactgggccggggccacacgtcagcatcttcaccatcagcagcagagcgctatccgtccggtgatcaacctgaccggcaccgtgctgcacaccaatctcgggcgggcattacaggcggaagcggcgatcgaggcggtggcacaggcgatgcgttctccggtgtcgctggagtacgatctggatggtgccgggcgcggacatcgtgacagcgcgctggccgccatgctgtgccgtctgacgggggcggaagacgcctgtatcgtcaataacaacgcggcggcggtactgttaatgctggcggctacggccagcggccaggaagtggtggtgtcgcgcggcgagctggtggagattggcggcgcgtttcgcattccggacgtcatgcgtcaggcgggctgcgagctgcatgaagtcggcaccactaaccgcacccatgcgaaagactatcgtcaggccatcaacgacaatactgcgctgctgatgaaagtgcataccagtaattatcagatcgaaggctttacgaaagccgtggacgaagcggaactggtagccattggcaacgagcgggacgtgccggtggtggtggatttaggcagcggctcgctggtggatctcagccagtacgggctgccgaaagaacctatgccgcaggcgctgatcgccgcgggcgtcagcctggtcagtttctccggcgataaactgctcggcggcccgcaggccgggatcatcgtcggcaaaaaagcgctgattgcccgtctgcaacagcacccgttaaaacgcgcgctgcgggcagacaagatgaccctcgccgcgctggaggccacgctgcgcctctatctgcatccggaaaaactcacgcaggatttgccgacgctgcgattgctgacccgcgataccgcgacgatccgcgccctggcggaaaaacttcagccggtacttgccgcgcattttgctgatttccacgtacagattgaagcctgcctgtcgcagattggcagcggttccctgccggtggatcggctgccgagcgtggccctgaccttcaccccgcaggacgggcgcggcagcaggcttgaaaccctggcggcgcaatggcgcactggtgaagtgccggtgattggccgcatcaccgatggccgcctgtggcttgatttacgctgccttgaggacgaaacccgttttctggagatgttactgaaatgattattgccaccgccggacatgtggatcacggcaaaacgacgctgctggaagcgatcaccggcgtgaacgccgaccgcctgccggaagagaaaaagcgcggcatgaccatcgatctgggttatgcctactggccgcaggctgatggccgcgtaccaggatttattgatgtgccgggccatgaaaagtttctcgccaatatgctggcaggcgtcggcggtatcgatcacgcgctgctggtggtggcctgtgatgatggcgtgatggcgcagacccgcgaacatctggcgattttgcagctgaccggccagacgacgctgaccgtcgcgctgaccaaagccgaccgggtggacgaggcgcgcattgccgcagtacaggacgaggtgcgcgacacgttgcgggagtacggctttacgagcgcggcgatattcattaccgccgccatcgcacagcgcggcatcgatgaactgcgcgagcatctgttacgcctgccggagcgggagcacgtgcagcatcagcgtttccggctggcgattgaccgggcctttaacgtgaagggcgcgggcctggtggtgaccggcacggcgctgtctggcgaggtgcgcaccggcgataccctgtggctgaccggcattaacaaacccatgcgcgtgcgcggtctgcatgcgcaaaaccagccggtcgatcatgcgatggccgggcagcgtatcgcgctgaatattagcggcgacgccgaaaagggatccataacccgcggcgactggctgctcagcgaggcgccgtcggagccgtcttcccgcgttatcgtggcgctgcaaagccatacgccgctgacacagtggcagcccttacacattcaccatgccgccagccatatcaccgggcgcgtctcgctgctgaccgacgatctggccgagctggtgctcgacagtccgctgtggctggcggacaacgatcggctggtgctgcgtgatatctcggcgcgcaccacgctggctggcgcgcgggtggtgatgctcgatccgccccgccgtggcaaacgtaaaacggcgtatctggactggctcgctactcttgccgccgcgcaggacgatgccagcgcgctggcggcgcacctgatccgcggtgccgtctccctgagccgcttcggctgggcgcggcagttaagccgcagtggaattgacgccttaacccgcaatgacgggctgatccagtcgggggacagcgtactgagcgcgacggtggccgcaggctggcagcgcaaactgctcgataccctggcaacctatcacgaacagcataaagacgaacccggccccggacgcgagcgtctgcggcgcatggcgctgccgatggaagacgacgcgctggtgatgacgttaatcgagcggatgcgggaaaacggcgacattgccagccatcacggctggctgcatctgccggaacacaaagccggttttaccgaagagcaggcggcgatctggcagcgtgcggcaccgctgtttgcggatgagccatggtgggtacgcgatctggcgcgggagacgggcacggatgagcagatgatgcggggtgtactgcgacaggcggcgcagcagggactgataacggcgatcgtcaaagatcgctattaccgtaacgatcggatcgtcgcctttgccagtatgatccgcgaactggatcaggcgcggggatcaacctgcgcggcagatttccgcgatcggctgaacgtcgggcgtaagctggcgatccagatcctcgaatattttgaccgcatcggctttacccgccgacgcggcaacgaccatctgctgcgggatgcacagctgttcccggaaaatagctgaatccagccgggtttttacccggctttaacctgctgttttgtcagccataccgcgccgagcctgcccgcctggttacccagcttgcacggcaggatgggcgctttcagaaattcccacatctcgaaggtttccagatggcgatcgagcagttgataaactttctcctgctcgcttaacccgccgccaatcagcacgacctgcggatcgtacatggaaatcacgctgtaaatgccacgcgacagaaagcgcgcccactggttaacggcttcgcgcaggtgcacgtcactgtccatacgttcgaaaatctctttgccgtgaggcatctcttcggcggagagtgccagcgcacggcggcaggcttccatcaggccacgggcggaagccacttcatgcatgcattcgccgtcgttaccgaccggcatcacgccaaactcaccggcacggaaatgcgatccgcgatacagttcgccgtcaaaaataatgccgccgccgataccggtgccgacggtgatacagacgacgttgtcgtaatcctgcgctgcacccagccagcgctcgcccagcgcggcacagttggcatcgttctcgacaatgactggcagatcgctgagttccgcaaacaactcgcgcaggttaatgccgtccataaagtccagcgctccggctttcatggcaacgccggtacggatgttgatgtatccggggaaactgatgccaacggcgacgatgtcgtgctccttttgatagccctcaaccaccgcctgccatttctgcttaaacgtctcaacgtcttccggcgtgtcgtactcgtccgaggtcagttcctcgccattctcatcaatcacgccgtgcttgatgtgtgtaccacccacgtcaaaaccaataaaatactgcatagtttttttcctgtgataaccgctcaggctaagtatggttcaggcaggccagcgcaacgtaaagtaaggtaataaacaccttcacttattcttaaattatgacggggtggcaggatagattaatccagtacagcgattctcagcggcctgaagcggctgtagatccaaagcccaaggcagctcagtgagccaagaatggccgtcatgatcgcactcataagaatgccgataagcagcccgaccggcagtgcaagcaaaccatgaatatactgctggttccagctcacggtgtcgtagccaaagcaggcgaataagccaaagataaagcccagtacggccatgggaatactcaggccgataagcagtaaacgataaatgctgcgggccttaatacgtttcatgtcggtcaccgcgcggttttcagtatccatacaacatcctgttgagtttaatgaattactattatgggctgaattcccgcgcggatctaatatgccgttactcttcattcacccagatacgcatctctccttcgcctcgattcgcccaactgaaccagggaataaacgtcagcttctgaggggtacgtctgacgggagaagtatcgtaatgccacagcggttgctgctcggcctgtgcggcggtacgtttataaccatccgcctgaatcagcactttatgcgcaaaaattcccttaccgtccagcgtagtaaagacgctgtcctccggcagccagagattatgcagctcttcgccgttatcggcctgttccagacaatacaccagcggtccgcgctgtacggcgactttaccagcctgatggcgcaccagcgggttgccatacacccgacgcacgggcattggcagcgtcagggaaagcgtatcgccttcctgccagacacggcgaagatgcagataacctttgcggatctcacccatggccgggtcgccattcagcgtaattgtcgggttggggcaccagtccggcaggcgcagggccaggatatgttccaccggctccggcgactcgatacgcagggtaagattttcctgccacgggtaattgccgctcagctgtaagcgcaacgttcgctccccaaccggaatctctgcccggttgccaatgtataaattaataaacagggtatctgcctgtggggtataaatgtaatggccgatggaggtcagcagacgggcgatattcggcggacagcaggcgcagccaaaccaccgctggcgcaccggctgtatgtggtcataaatatgattaaatggcagcgaacggggctgcacttccagtggattaacgtaaaagaagtgtttgccgtccagtgccatcccgccgagcaccgtgttgtatagtgcgcgctccatgacgtcggcataatggctgtcgccttccatttccagcatccgccgggcaaacatcatcaggccaatggaggcgcagctttctgcatacaccgtatcgttcggcagatcgtaatcgtgactgaacgcttcaccacggctctgcgagccgatgccgccggtaatatagagctgacggcgtgccatgttttgccacaaccgcagacaatcctgacgtttttgctcatctccggccagacgcgccagatgcgccacgccagtcatcagatagacaaaacgtaccgcatgaccgatggcactgtcctgttctgaaagcggtacgtgcgcctgactataggccttgtctttcaccatccatgcggtgccatgattcggccagtgccaggtgccgccacgcttttcaaactcagtatcatagaaatgcggctgagtgccgcgctgttcaacgaagtaggccacgagatcgcgataacgcgtctcgccggtgacttcatacaggcgcatcagggccagttcgatttccggatgcccatcatagccctgcagctggtccacgcccgggccaaatacacgatcaatgtgatcggcaagacggcagcccacgtcgagcagagcacgtttcccggtggcctgaaaataagctaccgccgcttcgatcatatggccagcagtgtacaattcatggcattccgcaagattcgtccagcgctcgccgggcgcttttaccgtgtaccaggtattgagataaccgtcttcacactgtgcggcggcaatcagcgcaatgacgtcatcggcagtcttttccagttcggggtcgggcttctggcacagggaccaggcgacggcttcgagccatttcgccacatcgctgtcctgaaaaaccatgccgtaaaattctccctcctgcagatcagcggcgatgcggaaattagcaatcgcatggctgggatcggcatccggaatacgatcattcagtgcatcccactggtaagggatcaccacatcgcgtaccagacgctgatactcgcctaaaaacggatcggtgaccttgagcgtgtgcaggtcggtttccattactttcattatcttctcctcaggactgaacatggcgctgacgcaaatcggtggcaatacgcgacatcatcgggttattaagtttgcaggcacgaatagtgacggccagcagcaggtggaaaagggcgggcaacagcgtttccatcgccgtaatgccctgtagcgaggcgggagtttgattgcctgcgccgggctggtaggcgacgacgataaaaagcaggctgatgatcccggcgctggatgcccaggcgagcttgataaaaaacaggttgaaggcaaagttcatgccggaagaacggacgccggttttccattcaccgtagtcatcggaaaaggccatcagcgaaaagtgcagcggcagcgtgaagccgaggatcacgccgttaccaagaatgaccgccagccatagggtctgatacgccgggccgcccggtaaaaaccacatcccgacagccagcgcggccaggaccagattggtgtagtaatacagttttacggcatcaatacgtcgggtcagggggttaacaatcaccgagcctaaaatcgaggcgaaagtcaccatggtaaaaaacagcgaggtataagccgtactgccctccagcacgtaggtgatgaaatacatgtagccgccgccgcgaatattgaacacgttgatcagcaggaatgacatcaccagcatcagtaacagctgatcgtttttacgcagcccggcaaggtgttcgcgcagggtaaatttacccatcagcgccagcggcacgcgttcacggacccagaaaaagcaacataaaaacatcaccacggcgagcgtgcacagcacgccaacgcccagctgataaccccgggcggcgtcgcccttgcccagcacgtcaaccatccacggcagtccgaccgagaccagaaatcccgccacgccgcacagtacgaagcgccaggactggcacgaaatcacctcattgtgccgggttgtcatggtattgatcagcgcacaatagggaacgttaatcgccgtgtagcccacggagagcagcagataggtgccaaacgcccaggcaatttttacgcccatgctggcatccggtacggtgaaggtcaggaaaccaataatgccaatcggtatggccacccacagctgccagggacgaaatcgtccccaacgactttgcgtacgatcggcaataatgcccatcaccggatcggaaatagcatcaaagacgcgtaaggcgataaacagcgtgccgaccaacgccggtgttagtccaaaaatatcggtataaaagaaggtaagaaaattcattatcaggcaggtaataaccgtgccgccggcatcgcccaggccgtaacctattttttcgcgtaccgataatagggcgtcgtgattagaatgggcgatatctgtttcagacagagatgtagaggtcatcgataactcctcgcagcgtggagaggccgtttttacgttgcccgtgaaacaccacaggccgttattatgggttatgaccttattaattctgcccggattattaccgccaacaaggcaacaaagaagtataaaaagatgacgatcccgacctcatcggaaaagtgtgaagccgatcgagctggtggggaataattcattaataatcaatttataagcctttaattattggcgataagaacaggaaattgaatattcatgcttaatttatccataatacatccgattaaagtgcaaaatggcggtttatttatttcacgcggtatggggcgtcatccggctcgtaaactgaattcatgggaagtgattttcgtcgaaaaggggatgttgacgatcgaggaagaagggcagctatttaaggtcagcgccggggaaagtctattattatggccacagcggcgtcacgtaggcgtggaggattttcccgccgatcttaaattctactggctgcattttgaagtgcaggaaagcagcctgcctgttgagtcgacgctaacgcttaccgtaccgcagcatactacgccagaggatccgcaatatgttatttccttgttccgccagtttctgagcgaacaggaaaaattaacgcgcagtgccgctctggaacttattttattactgatcctgcaacaaattaccctgaccggaagtgccgaaacgcagcaagacgatcggggagtgtcttttgcctggaaagcgcagcagcttattcgtacgcagtatcatctgcccgtttccaccgccacgctcgcgcgggaattacactgcaatgccgattacctcgggcgcgtttaccggcgtacgtttcacctcacgctgacggaagcgatccaccgccagcgggtgcggacggcagaaaagtttttactcagcgatgcgtgttcgctgaaagagattgccacgctgtgcggcttcagcgatgtcggctatttcagaaaaattttccgtaagcacaccggcttaacacccgccgtctggaaacggcgctactgcaaggaacatataaattcatgaaattattatcggtttacagaaaattcagtcaatccattaacgtaagttattaaaattccacgtcacggtgaggttatagcgccagtcgcgacggcggttgtcggtgggcacatcgcccgtgggacgggctgcttccaccgccagcgtatagtgtttgttatcgccgaccatcacgcccgccgccaccgagcttaaccgctgctggcgaaagccggacgcgttataccaggtgcgtgcggtgtcggccagcacgtagggctgtaccgtcgccagccatttgctctctttacgactgtgcaggtagcgcagctccagttgaccgccatagccgtaatcgccgctggcttcgccgtcctgatagccgcgcccgaaacgctgcgcgccgaactgtacgcgctccggatccggcagcgtggtatcagaccagacgccttccatggatgaactcagtcgccatttctccgtcatcatccagcctgcatccaggttgcctttccagcgggtaaagctgagatcggtaccggccaccggagagacgtccgcgtcaaaggtatccagcccctggcgcaggttcagccgggcgttgatgctggccttactgaattcccggtagccggtgatccccagatccagcgccggataacgggtatgctgactctgggattccagcggaatggtctgcccgaagccgcgcgccaacaggtcgatatcgttacgtttgttggtgtagtccacgccgccggagaggctgatttgcttctggcgggtgagcaacagtggatagccaaaactgatgccgccgttgtattgcgtggattgctgacgggcatccaccgtgaacccgttaagattcagcaagggagtgaactcctcaggatcgtcacgataaaagctgccccgaagctgcatactcagcccttcgtcagtgaggaactgctgataattaagcccgacataagtcttgcgggtttcaccgtccagcgggataaaagtggcgacgccgagctgatcgccataacttgtgaggttgctcaaggtgccgttgaccagcgccaggttttcgcctctgcgcacgtcgagcgtggaagagagatcccagatacgcggctggctggcgtccactttcatcgccgccgcgccataaatattcttcggcagctgcgcattcacatccactttggtgcccggcgtgcgggtcatcagcaggctgtagcgatcgaatgtttcctgtcgcaatggcttttcggtcatcattttttccgccagccgcttcaggcgtgcggcgatgctggcgttgttgctcttaatatcactgtgggcaacatacccttcgaccagcacgatgttaattttgccatggtgaaaattattgtccggcagccaggcataagagagcgggtagccatcggcccggtagcgggcggtaatatcatttaccagccggatgatctctttcagcggtacggttttgcccgcataagggcgaaagggggcaagcaggcttttcagcgggtaaagcttgccgccaataaactgaatatgtttgaccaggatcggcgtatccggggtgagctgcgtggcggattttgggaccgtcaccgtcggcgcgcggcgttgaaccgcagtgggatcctgttcgccaggtacggcttttgacgggttaaccggatcgataatggcggggagggtatccgcccgggcgatgccgagcaccgcgccgcacatgagcgcatagcagaggtgtagtctcatgatgcattcccttcaggaaaacgtgcccccgggcgggggcacggtacagcgtgttattgtttcggttttaatagtccgccaacgataccggtcacgccgctaagcggacctgaggcggtcgttccactggtgtcattgctggttgtcgtcccggcgctggcggtcagtccggcagtcaggttattgaccgtggcgccgacattggctaccagaccggttttactggcatccgccgtcgcatccactgcgataccacccgttgagctggccggaggcgcagtgacggtggctggtttaaccacgccgcccacatccgcaaccgtctggccaaggttgctgaccacctggccgacgccgctcaggcccgcattactgctggtcacctggttacccacaccgctgacgccattgccaacgtgggttaacagattactgaccggtgtgccgaggcctgttgcgccacccacaccctgagtcacatgctctacgcctgcggtagtattgttaaccagcgtggtggtgccggtagtcaggcgggacacgccgtcgctttgcaccacgttagtcagcgcggtccccgtgccgctgacgacctgcccggtgctgttcacgatggcaccggttgggcctgtgaggctgcgtaatgacgatgacgaggtggtgctggcaagattggtgccgacgtcagacacggtgccgcccagcgaggtcacggtagtagtcaccccgcttaatgtcgtgcccacgccgttgacgtttgaacgatcgccgataccgttggtgatgccgctgccggtggtatcaatggcggtgccaacgccgctgacggtggtcgccacggtggaggtcaccggattgctggtgggcaactggctaccgagattatcgagcgtggtacctacgccggaaagggtttcaccggtatcgctgagaatggtgctgaccgcgccgttagcggcagtatctgtgccgcctgagccgccgtcagagccaccacccgtaccgccaccaccacctgtactgccgccggatccgctgccgtcagagcccgatccgttgccgccggaacccgatccgcctgtacctgtgccggaacctccagctccgccattcgcgccgctgccgccagcgcctgtacccgtaccgccggaacctccgccgcccgagccgttgttcgccgttgacgtcccatcgttagtccccgctcctgtgctcgtccctgcggttggcgtttttttcacactggaatgagaaccgccgccgctacaggcagataatgagaatgcaagaagtacggccaccgtaatgacgctcaggtggctaacgttattagtagccatgatcatactccactaaataaaacgccggacggcgtattaatgagtgtaagtagctttttgacggcaacaacttttgttgcatgtatttttaaataaagttaataaattgtgattattcctaataatcaaataaagtgaatttaaaaaaatccttgtttatcagtatctttattttttatgtagaagcgtaagcggcgctgaaaccctgccaggatatgtagccccgattaaattatttataagttaataagcatgctaataactgatgcggatatatcgcatcaaaaacattattttaatatggggcgtaactacgggcggcgaaatattccggacttgatcacacaagcccggatatattcttttaaagctgactttcctgccaggcgaattcaatctcttcggcaagcactttaatgcctgcctcgattttgtccggatcaggaacatagttcatgcgcatacactggtgcgtgtgcggccagggtttgtcgaggccggggaagaaataatcccctggcaccatcagtacgccgcgttttttcaggcgctggtagagcagttcggtggtgatcggcagatctttaaaccacagccagaggaaaatggctccttccggcttgtggatcaggcagcgctcttccggcaaatagcggcgaattgtcgcaaccgtctcctgtacgcgctgctgatagaacggcttgataacggtttccgacaggcgcagcagatcgttacgcttgatcatttcgcacatcatcgccgggccgataccgccgggggcgaggctgatgatgccgttcatattgcggatcgccgagataattttttcatccgcaatgatgatcccacagcggctgccgggcaggccgagcttggagagactcatgcacagcacggtgtttgggttccacagcggacgcgcatcgctgaagatgatcccggggaagggcacgccgtaggcgttatcgatgaccagcggaatgccgtgctgattcgccagcgcgtccagcttcatcagctcatcatcggtgatcacgttaccggtcgggttggtcggacgcgatacgcagatcatgccggtttcttccccgatatgcaggtgctcgaaatcaacgtgatatttaaactggccttccggcagcagttcaatgttggggcgcgccgagacgaaaagatcttcttccaggccggaatcggcatagccgatgtattccggcgccagcgggaacagcacttttctggtgcttccatcggcacgacgacctgcgaacagattgaacaagtagaaaaacgcgctctggctgccgtttgtcagtgcaatattctgcggctcaatatcccagccctgagtttcccgcagcatttgtgcaaggcagaccagcagctctgacttaccctggggaccgtcgtaattgcatagcgcatcagtggctttgccggagctgagcatatcggcaagcagctggtggaaataatcggtcatttccgggatttgcgccgggttgccgccgccgagcatgatggcgccaggcgtgcgcaggccgtcgttgagatcctccatcaggcgggtgatgcctgaatggcgggtgaatttgtcgccgaaaagtgaaaatgtcatagcaggtggtctgtcggtctctttgaatttgccccaccttaacgccagcgcaggcgcggtgcaaatcggacaaaggccggtgtgatggaataaaatgctgctggctgtggttatgatgaatttttatgccgcaggcagagggtggaataaaaaggcgttacaggacggttaacggccagtggacgtagctctgccactgacactcctgatcgataagctcagcgcccagcggatggctggtcagccagtcatgcggcagggacagcgtcagactttcttccaccgccgtcagggtgatggccggcaacaaatcgtcacgacgacggctggcgaaaataatcgccagacgcagcagacggcacaggtgttccgccacgcgcggcggcacggcgttttgctgatgcaacgaggagagatcgaccgtactggtctggttaagcaacagggtcgccagcagctttttctgcgcaggagtgaagcccggcagatccagattgcgtaccagataggcagcgtgctgcggcgcggatttaaaatcgacgctgaggccgatttcgtgcagctgacaggcgctgaccagcagatcgcgcgacagcggctggagatcccagacgccttccacctgcgcggcaaaacgggttgccagctgcgcgacgcgcaaagcctgttcggtatcgaccataaaacggcgctgaatgttacgcagcgtgcggttgcgaatgtcctgatccaccgacagatgcagcatgccgtacaccaggccttcccgcagcgcgccgcctgccagagtcatacactgaatatccagctcggtgaagatggcgataaggatcgccagcccgctcgggaaaaccagcgcccgctccagcgtcaggccttcgatttccagctcctcaagacgaccacactgaatggcgcgctgtttgagctgctgaagtttggccagcgtgatgcgctcgtccatgccctgcgccatcatgatttcctgtagcgcctgcaccgtgccggacgcgccgacgcagactttccagccgtgcgcgcgtagttcattggccaccggacggatcaccgcgcgcgcggcgcgttccgcctcgtcgaagtgctctttcgccagattacggtcggtgaagtaacgctcaagccaggtgacgcagcccatcgacaggctgaacagggacgtggcctgcgcgccggtgccggtcaccagttcggtgctggcgccgccaatatccaccaccagacggcgatcgtcgccaccggtggtgtgcgccacgccctgataaatcaggcgcgcttcttcctcgccgctgatgagttgcaccgggcagccgaggatttcctgcgctttcgtgataaagacatgggcgttgacggccaggcgcagcgtcgccgtggcgaccacctgaatttgtacctgcgggatgtcctgcaaacgttctgcgaacagacgcaggcattgccagccgcgctccatggcttcgggcgagagcacaagatcgctgctcaaacccgccgccaggcggactttgcgtttgatgcggctcagggtctgtatgctccccgccacctcgcgtacaaccagcatatgaaagctgttagagcctaaatctattgcggcgtatagcgaagtagtggtgagcatcttttttaacccggacgacgacgattacgcggtgcgccagggcggcgctgattattgcctggacgggcgcgggtgaggcgcaacggcttcggcagatctttcagtagcgcgtccggattgtatttgctgaccggaatagagtggccggtgtaagtttcaatcgccggcaggttcagcgcgtactcttcgcaggccaggctgatggaatgaccgcttgcgcccgcacggccggtacggccaatacggtgcacgtagtcttcacagtcatccggcagatcgtagttgaagacgtgcgtaacggctggaatgtgcagaccgcgcgcggccacgtcagtcgctaccaggatgtccaggtcgccacgggtgaattcttccagaatacgcaggcgttttttctgcgccacgtcgcctgtcagcaggcctacacggtgcccgtcggcggctaaatggccccagatatcttcgcaacggtgtttagtattggcgaaaatgatggcgcgatccggccactcttcttcaatcaacgtctgcaacagacgcattttttcttcgttagacggatagaacagctcttctttgatgcggtggccggttttttgctccggttcgacttccacatattcagcgttgttcatctgttcaaaagcgagttcacgcacacggtaggacagggtggcggagaacagcatgttgagacgttcagtgaccgcaggcatacgacggaacagccagcgaatgtctttgataaagcccaggtcatacatgcgatcggcttcatccagcaccaccacctgaatcgcgccaagattgatgtggttctgttttgcgtaatcgatcagacgcccggtggtgccgatcagaatgtcgacgccgctttccaggactttaagttgtttgtcatagccatcgccgccgtaggcgaggcctaatttcaggccggtagtctgcgccaggggttcggcatcagcatggatctgcaccgccagttcacgggttggcgccatgatcagcgcacgcggttggttcaccttgcggtctgcgatcgccggatgagagagaagataatgaaacgttgacgtcagaaacgccatcgttttcccggtaccggtttgcgcctgtcctgctacatcacgaccagccagcgttagcgggagcgccagcgcctggatatgtgtgcaattatgaaagcctttgttttcaagggcttcgatcaccttagggtgcagggcgaagtcggtaaacttctgttctgttaaatgtgttttgctcatagtgtggtagaatatcagcttactattgctttacgaaagcgtatccggtgaaataaagtcaacctttagttggttaatgtggcatcaatacgttgtagtttcatgctacatcagcacgccaggcttattcctgtggagttaaatatgagcgataaaattattcacctgactgacgacagttttgacacggatgtacttaaagctgaagggctgaccctcgtcgatttctgggcagagtggtgcggtccgtgcaaaatgatcgctccgattctggatgaaatcgctgacgagtatcagggcaaactgaccgttgccaaactgaatatcgaccagaacccgggcactgcgcctaagtatggtatccgcggtattccgaccctgctgctgttcaaaaacggcgaagtagcagccaccaaagtcggtgcgctgtctaagggtcaactgaaagagttcctggacgccaacctggcataatccagcgcaaacccagcctggcgtgctgcgttcctaattttttgggatcgctggacgcccggcttcagtcgtgctaagtttgttttgacttcgttttaaacatacctttgtagtttgtacccgatacttcccgctgagcaccatcgccgcgagagaagtagatagattccgggcttgtcactcaatccgtcttgtcgtttcagttctgtgttcttcccgtaagcaggcagcgaacagacatgagttgatggccgctaaaacaggcatggatgaccctgccataccattcacaaattaagttcgagatttaccccgagtttaagaacccacaccactatgaatcttaccgaattaaagaatacgccggtttctgagctgatcactctcggcgaaaatatggggcttgagaaccaggctcgtatgcgcaagcaggacatcatttttgccatcctgaagcagcacgctaagagtggcgaagatatatttggcgacggtgtgctggagattttgcaggatggatttggtttcctccgctccgcagacagctcctacctcgccggtcctgatgacatctacgtttcccccagccaaatccgacgtttcaacctccgcactggtgataccatctctggtaagattcgcccgcccaaagagggtgaacgttactttgcgctgttgaaagtcaatgaagttaactacgacaaaccagaaaacgcgcgtaacaaaatcctgtttgagaacctgaccccgctgcacgcaaactctcgtctgcgtatggaacgtggtaacggctctacagaagacttaaccgcccgcgttctcgatctggcctcgccgattggtcgtggtcagcgtggtctgattgtggcaccgccgaaagccggtaaaaccatgctgctgcaaaacattgcccagagcatcgcctacaatcacccggattgcgtgctgatggttctgctcattgacgaacgtccggaagaagttaccgagatgcagcgtctggtaaaaggcgaagtggttgcgtccaccttcgacgaaccggcttcccgccacgttcaggtcgctgaaatggtgatcgaaaaggcgaagcgtctggttgagcataaaaaagacgttatcattctgctcgattccatcacccgtctggcccgcgcctacaacaccgtggtaccggcttccggtaaagtgttaaccggtggtgtggatgctaacgccctgcatcgtccgaagcgtttcttcggcgcggcacgtaacgtggaagagggcggcagcctgaccatcatcgccaccgcgcttgtcgataccggttctaaaatggatgaagttatctacgaagaatttaaaggtaccggcaacatggaactgcatctggcgcgtaaaatcgctgagaagcgtgtgttcccggcgatcgattacaaccgttcaggtacgcgtaaagaagagctgctcaccacgcaggaagaactgcagaaaatgtggattttgcgtaagatcattcacccgatgggcgagatcgacgcaatggagttcctcatcaacaagctggcgatgaccaaaaccaacgacgaattcttcgacatgatgaaacgttcgtaagtcttatcaattttgctggttctggtgaatgatttgacggcggtttgcatcgacaggctgatgtgaagatgcgggaaaaacgcgcagtttctcacttgacggagcgcgcgtaatccaaataaagccccgaaacgccacgttttacgtggcgtttttcttttgcggaatatacgctataaccacggagccacaagatgcttcgggcagcgcgcgatattacggaacattcactataagaatggcctaattgattgaaaaacatacaacagaccctgtgtatgacccgctttattgcttcttgagcaaggtcaacgtcgttatacttccaggatcaacattcgctgagagcatgcattgtgaatttactcactgcggttactgagttattcagtatttttttactcacttttatctttctttttttcgcacggaaaatcgcgaagaaaatcggtctggtggacaagccaaacttccgtaaacgacaccaggggctgatcccgctggtgggcggtatctctgtttacgccgggatttgctttacgttctacattgccgattactacatacctcatgctgctctctacctggcctgtgcgggcgtacttgtcttcgtgggcgcgttagacgatcgttttgatatcagcgtaaaaattcgtgccactatccaggcgcttatcgccgtggtgatgatggccgtcggcaagctttatctcctcagcctcgggcatatttttggctcatgggaactggtgctcggaccgttcggtttcttcctgacgctgtttgccgtctgggctgcgattaatgccttcaatatggttgatggtattgatggcctgctcggagggttgtcctgcgtctccttcggggccattggcatcattctgtggttcgacggtcagaccagccttgcgatgtggtgcttcgccatgatcgccgccatcctgccttatattctgctgaaccttggtgtgcttggccgccgctataaagtgtttatgggcgatgcgggcagtacgctgattggttttaccgtgatctggatcctgctggaaaccactcagggccaacgccatccgataagcccggtcacggcgctgtggatcatcgccattccattaatggacatggtggcgattatgtatcgtcgtctgcgtaagggcatgagcccgttctcaccggatcgtcagcacatccaccatcttattatgcgtgccggctttacctcccgtcaggcattcgtccttatcacgctcgctgccgccctgctggccgctatcggcgttgtgatggaatatgtacatatcgtaccggaatgggtgatgttggcattgttcttgctagcatttttcctgtacggctactgtattaaacgggcatggaaagtcgcacgcttcattaaacgtgtgaaacgccgtctccgtcgcaaaagcagacataatccaccattaaccaagtaattctgggatagcgatgactcaaccattaccgggagcacaatcagtaggtacggagaatgaactggatattcgtggtttgtttcgtactttgtgggcagggaaattctggattgcaggtgtggcgctggttttcgccttgatcgtattaccctatacctttttcgcgcgtcaggagtggagcgccacggcgatgaccgatcggcctaccgtgaacatgcttggcggctactactctcagcagcagttcctgcgtaatctggatgttaaagccagcctggcgccggtcgatcagccttcggtaatggacgaggcctataaagaatttgttatgcagctggcgtcatgggatacccgccgtgatttctggttacagaccgattattacaagcagcgtacggtgggcaacagcaaagccgatgccgcgatgctggatgaattaatcaactacatccagtacacgcctggcgacgccctgcgtaacctgaatgacaacgttaagctgacggcggaaacggcgccggacgctaacaatctgctgcgtcagtatgtggcctttgccagccagcgcgctgccagccatctgaatgatgagctgaaaggcgcatgggccgcgcgcactattcagatgaaggcgcaggtgaaacgtcaggaagaggtggcccgcgctattttcaaccgccgtgtccacagcgtggaacaggcgctgaaagttgccgaacaacacaatatttcccgcagtgaaaccgaggtgccggccgacgaactgcctgattcagaaatgttcctgctgggccgtccgatgctgcaggcgcgcctcgaaaacctgcgttccgtcggcccggagtttgacctggactatgaccagaaccgtgccatgctgaatacgctcaacgtcggccccacactggatccccgttttcagacttatcgttatttgcgcacaccggaagaaccggtaaaacgcgacagtccgcgtcgtgctttcctgatgatcatgtggggaattgtgggggcgttagtcggagccggtgtagcgttaacgcgtcgtcgctcatactaaacgccgtctgagatgaaggccgccgtgccttcatcatctaatcgaagagaatcgttgtgaaagtacttaccgtatttggcacacgaccagaggccatcaaaatggcgcctctggttcatgcactggcaaaggatccttatttcgaggcgaaagtgtgcgtcaccgcgcagcatcgtgagatgctcgatcaggtgttacatctcttttcgatcgttccggactacgaccttaatattatgcagccgggtcaggggctgacagaaattacctgccgcattctggaagggctaaagcccatcctcgaatcttttaagccggatgttgtgctggtacatggcgataccactaccaccatcgccgcaagcctggccgcgttttatcagcgtattccggtaggccacgtggaagcgggcctgcgcaccggcgatctctcctcgccgtggccggaagaagccaaccgcaccctgaccggtcatctggcgatgtaccactttgcccccacggaaaatgcccggcataacctgctgcgggagaacgttgccgataagaaaatttttgtcaccggcaataccgttattgatgcgctgttctgggtacgcgataccgtgctgaacaacgaggcgctgcaaaacgagctggccggacgctatccgtttatcgataaatccaaaaagctgatcctcgtgaccggtcatcgccgcgaaagctttggtcgcgggtttgagcaaatctgtcacgcgctggcggacatcgccgccgcccatgatgatgtgcagattgtctatccggtacacctcaaccctaacgtcagcgagccggtaaaccgcatcctggggcacgtggataacgtgattctcatcgagccgcaggattacctgccgttcctctggctgatgaaccactcgtggctgatcctgacggattccggcggcattcaggaagaagcgccttcattaggcaagccggtgctggtgatgcgtgacaccactgagcgcccggaagccgtggaagccggtacggtcaggctgatcggtaccgacagacagcgtatcgtggatgaagtcacgcgcctgctgaccagttttgatgcgtggcaggcgatgagccacgcgcacaatccgtatggagacggtgaggcctgcggtcgaattttgcacgcacttaaacacaatcgggtaacgctatgagcttttcaaccatttctgtcattggccttggctacatcggactgccaaccgcggcggctttcgcctcccgtcaaaagcaggtagtgggtattgatatcaaccagcacgcggtggacaccattaatcgcgggcaaattcatattgttgaacctgaactcgacagcgttgtaaaagcggcggttgagggcggttttttgcgcgccagcaccacgccggtggcggcggatgcttacctgattgccgtgccgacgccttttaaaggcgatcacgatccggatatggcctacgtggaagcggcagccaaatccatcgcgccggtgctgaaaaaaggcgcgctggtgatcctcgaatccacctcacctgttggcgcgaccgaacaaatggcgcagtggctggcggaaatgcgtccggatctgagcttcccgcagcaggcgggcgagcaggcggatattaatatcgcctactgcccggagcgcgtgctgccaggccaggtgatggttgaactgatcaaaaatgaccgcgtgatcggcggcatgacgccggtgtgctccgcccgcgccagcgagctgtacaacatcttccttgaaggtgagtgtgtggtcactaatgcccgcaccgctgagatgtgcaaactcaccgagaacagcttccgcgacgtcaacattgcctttgccaacgaactgtcgctgatttgcgccgaccagggcattaacgtctgggagctgatccgcctcgccaaccgccacccgcgcgttaatattttgcagccgggaccgggcgtgggcggacactgtatcgccgtcgacccgtggtttattgtgtcgcaaaacccgcagcaggcgcggttgatccgtaccgcccgcgaagtgaacgacagcaaaccgcagtgggtgctgaatcaggtgaaagccacggttgccgactgcctgacggcgagcggcaaacgcgccagcgaacttaacatcgcctgcttcggcctggcgtttaagcccaacattgacgatttacgcgaaagcccggcaatggaaatcgcccgccagatcgccgaatggcacagcggcaacaccctgatggtggagccgaatattcatgcgctgccgaaaaaactcgccggtctgggcgaactggtgagccttgacgacgcgctggcaaaagctgacgtcatcgtcatgctggtggatcatcagcagtttaaagctcttcccggtgaagcgatcacgcagcagtatattattgataccaaaggcgtctggcgatgacagccccgtcctttccgctgcacggtacggttgagcctcttggctgggaaagccagtttttcggcctgcacagcgctattgtgcgcctgagcgacagcggcccggcgatcaccgaagccgatctcaacgcctgggaacgggtgcaggtcaaaattccggccagcgatgcggcacggctggacgcgctgcaacagcgcggttttcagctggtggaaggggaagtggatctcgcgctgaacctctgcgcgacggtggccgatccgcaggcgcaggtcgccggcgctgaagatattccgcggctgcgcgagctggcggcacaggcattcgcgcaaagccgttttcgcgcgccctggtatccgccagaagccagcggacgtttttacgcccagtggattgaaaacgccgtcaaaggcgagtttgatcaccagtgcctggttttccgcgccgctgacggcgacatccgggcgtttgtctccctgcgccagctcaatgaccatgaggcgcgtattggcctgctggccgggcgcggcgcgggtgaagccctgatgcaggcggcgtcatactggacgcagacgcgccagctgacaaggttacgtgtggcgacgcaggcgggaaataccgccgcgcttaaacgttatattcaaagcggtgcgaatgtggaaagcaccgcctactggttatacaggtgacatgatgatcccttttaacgcaccccccgtagtaggcagtgagcttgaatacatgcagtcggccatgggaagcggcaagctgtgtggcgatggtggttttacccgtcgctgtcagcagtggatggaacaacgctttggcagcgcgaaagtgctgttaacgccgtcctgcaccgcgtcgctggagatggccgccctgctgctggatattcagcccggcgatgaggtgatcatgccgagctataccttcgtgtccaccgccaatgcctttgtgctgcgcggcgcgaaaatcgtctttgtcgatattcgcccggacaccatgaacattgatgaggcgcgcatcgaagcggcgatcaccgaaaaaacacgcgccatcgtgccggtacactacgcgggcgtcgcctgtgaaatggacaccatcatggcgctggcgaagcagtacaacctctttgtggtggaagatgccgcgcagggcgtgatgtcgacctacaaaggccgcgcgctggggacaatcggccatattggttgctttagcttccacgaaaccaaaaactacaccgccgggggtgaaggcggcgcgacgctgatcaacgaccgcgcgctcattgagcgggccgaagtgatccgcgaaaaaggcaccaaccgcagccagttcttccgtggtcaggtggataaatacacctggcgcgatatcggctccagctatctgatggccgatttgcaggccgcctacctgtgggcgcagctggaagcggcggatcgcatcaatcagcaacgcctgtcgctgtggcagacctatttcgacgcgctctccccgctggcacgcaccggtcgcattgaactgccgacggttccggcggattgcaaccacaacgcccatatgttttacatcaaactgcgcgatgaagccgaccgcagcaagctgatcgccttcctgaaagaggcggagattctcgcggtgttccattacattccgctgcactccagcccggcgggcgaacagtttggtgagttccacggcgaagaccgttacaccacgcaggaaagtgagcgtttgcttcgcctgccgctgttctacaatctggcaccggtcaatcaacgtacggttatcagcaccctgctgagctattttaactgagatgtcgctggctaaagcttcggtgtggaccgccgcgtccacgctggtcaagattggcgcgggactgctggtggtgaaactgctcgccgtggcttatggcccgtcgggcgtcggccaggcgggtaacttccgccagctggtgaccgtgctcggcgtgctggccggggcgggtattttcaacggcgtcactaagctggtggcgcaataccatgacgatacggcgcagctacgcaacgtggtcggcacctcgtccgcgatggtgctgggtttctcgacgctgctggcgctggttttcctgctggcggcggcgcccatcagccaggggctgtttggtcatacgcattttcaggggctggtccagctggtggcgctggtacagatgggcatcgcctgggcgaacttcctgctggcggtgatgaaaggctttcgcgatgcggcaggaaacgcgctggcgctgatttgcggcagtattgtgggcgtgatggcctattatgcctgcttccgcctcggcggctatcagggcgcgttactggggctggcgctggtaccggcgctggtggtgatcccggcgactgtgctgcttatccgccgtaaaactattccgctgggttacctgaagccgcaatgggataaactgttcgccgggcagctggcaaagtttaccctgatggcgctcattacctccgtcaccctgccggtggcctatgtgatgatgcgaaacatgctcgcggcgcattacagctgggacgaagtggggatctggcagggggtcagcagtatttctgacgcctatttgcagtttattaccgcctcgttcagcgtttatctgttgccgacgctctcgcgcctgacctcgaaacaggacatcacccgtgagatcgtcaagtcgctgaaatttgtattaccggcagtggcagcggcgagtttcaccgtctggttgctgcgggatgttgccatctggctgctgttctctgacaaatttatcgccatgcgtgacctgtttgcctggcaactggtgggcgatatactgaaagtgggtgcttacgtcttcggctatctggtgatcgcccgcgcctcgctgaaattttatattctggcggaaatcagccagtttgccctgctcaccggattttcccgcgtgctgatcccggcgcacggcgccgcaggcgcagcgcaggcctatatggctacttatattgtttatttcgccatttgttgtggcgtgtttttgctctggcgtaaacgggtatgactgcactcattcatgtactgggatcgaatatcccacaccataatcaaaccgtgctgcggttttttaacgatcacctcgcctccacaggcgagcatgcgcgcgaatttatggtcgccgggccggatgacggctacagcgccgcttttcccgcgctgcgactgcgtttctttgccgacaaaaaatccctggcgcaggcggtcatctcgctggcaaaagccgatcgcgggcagcgctttttctttcatggtcagtttaatactgacctgtggctggcgctgctgcgtggcacgatcaagccgcagcagttcaactggcatgcctggggcgcggatctgtatgaagtgtcgcagagcctcaagtttcgcctgttttatccgctgcggcggctggcccaggcgcgcgtcggctgtatctttgccacgcgcggcgatctgcaattttttgcccgtcgccatccgcaggtgcgcggcgagttgctctacttcccgacacgcatggatccgtccctcaatactatggcgcctgccgtacgtagcgaaggcaaactgaccgtgctggtgggcaattccggcgatcccagcaatgagcatatcgctgcgctgaaggccattcaccagcagtttggcgatacggtgaacgtcattgtgcctatgggttatcccgcgaataacgaggcgtatatcgcgcaggtccggcaggcgggtgaaaccctgttcagcccgcagcatttgcgcattctcagcgagaaaatggaatttgcggaatacctggatttactgcgccagtgcgatttgggctattttatctttgcccgtcagcaggggatcggcacgctctgtctgctgatccaggcgggtgtgccgtgcgtgctcaatcgtgaaaatccgttctggcaggatatggtggagcagcacattccggtgctgtttaccggtgatgcgctgaacgaggcggtggtgcgcgaagcgcagcgccagctggcggcggtggataaaaacgccattaccttcttcagccctaactatctgacgccctggcatcaggcgctgcgtatcgcggcgggagaggtggcatgagtcagcttgagttctgcggattactggtcatctggctgctggcctcgctgtttatcggcacgctgacgtggtttgaattccgccgcgtacgctttaacttcaacgtgttcttctcgttgctgtttttgctgaccttcttcttcggtttcccgctcaccagcgtgctggtgttccgcttcgacgtgggcgtggccccgccgggcattatgatgcagagcctgctggcggcggcctgtttctatgccatctattatgtgacctataaaacccgtttgcgcccggtagggcaggaacgcgaacgccgtccgctgttcaccattaatcgggtggaagcgcatctggcgtgggtgatgctgatggggatcgcgctcatcagcgtgggtattttctttatgcacaacggctttttgctgttccgcctgcattcgtacagccagattttctccagcgaagtctccggcgtggcgctcaagcgtttcttctacttctttattccggcgatgctggtggtctattttctgcgccaggacgggcgggcatggctgttcttcctcgtcagcaccgtggcttttggcctgctgacctatatgatcgtgggcggtacgcgcgccaatatcattatcgccttcgccatctttttatttatcggcatcattcgcgggtggatctcgctgtggatgctggcagcggcgggggtgctcggtattgtcggcatgttctggctggcgcttaagcgttacgggctgaacgtcagcggcgacgaagctttttataccttcctctacctgacgcgcgataccttctcgccgtgggaaaacctgtcgctgctgctgcaaaactacgacaaaatcgacttccaggggctggcgcccattgtgcgcgatttctatgtgtttatcccgacctggctgtggccggaccggcctggcattgtgctgaataccgccaattactttacctgggaagtgctgaataaccactccgggctggctatctcgccgacgctgatcggttcgctggtggtgatgggcggcgtatggtttatcccgctcggtgccgtagtggtggggatgatcattaagtggttcgactggctgtatcagctgggcaaccgggaaaccaatcgttataaagcggccattctgcacagcttttgtttcggcgccattttcaacatgattgtgctggcaagggaagggctggactcgttcgtctcgcgggtggtctttttcctcgttgtctttggggcctgtctggtgctggccaaactgctgtactggctgtttgacagcgccgggctgatccatgcccgcgtgctgcgcgcccacaaaaccctttcacaggtctgataaggaatcccatgactgacaaaaccgacgccccggtgtacaccctgcgcgggctgaagctgattggctggcggaatatgcaacatgcgctggatcacctctatgccggaggcgcgctgaagcagggcacgctggtggcgatcaacgccgagaaaatgctcgccgtggaaaatgacgcccaggtgcgggccctgattgaagcggcagagtataaatatgccgacggcatcagcgttgtgcgttccattcgcaaaaagtatccgcaggcgaaggtcgagcgcgtggccggggcggatttatgggaagagctgatggcgcgtgccggaaaagagggtacgcccgtctttctggtgggcggtaagccggacgtactggcccagacgcaggaaaagctgcgcgcgcagtggcaggtgaatattgtcggcagtcaggatggctacttcactgcagaccagcgtcaggcgctgtttgagcgtatccgcgacagcggcgcgaaaatcgtcaccgtggcgatgggctcgccgcgccaggagatcctgatgcgggattgccgcgaggtatatccgcaggcgctctatatgggcgtaggcggcacctatgacgttttcaccggccatgtgaagcgtgcgccgaaagtgtggcaacgtatgggtctggagtggctttaccgcctgttatcgcaaccgagccgcctcacccgccaactgaagctattgcgctatcttgcctggcactatcgcggccagatgtaatcgacaggcagcgcggtgcaatgcgccgcctgcttttttattgagcaactcatacgtttttgttaaccatcgtttgccattttccccgaattaagaaaccattcgcccactcaatgcattgcactgagtcataactataacccgcaccgccgggaacagtagcagacacaacagaggatttatggccgagaacaaaccggagcttcagcgtgggctggaagctcgacacatcgaacttattgccctcgggggcacgataggcgttggcctgtttatgggcgcggcgagcaccctgaaatgggcagggccatcagtattgctggcatacattattgccgggctgttcgtcttcttcatcatgcgctccatgggcgaaatgttattccttgagccggtcgccggttcctttgccgtgtacgcgcaccgctacatgagcccgttcttcggctatctcaccgcctggtcctactggtttatgtggatggcggtgggcatctcagaaatcaccgccatcggcgtgtatgtgcagttctggttcccggaaatggcgcagtggatccccgcgctgatcgccgtcgggctggtggcgctggcaaaccttgccgccgtgcgtctgtacggtgaaattgagttctggtttgcgatgatcaaagtcaccaccatcattgtgatgatcgtggtagggctgggggtgattttcttcggctttggcaacggcggccatgcgattggctttggcaacctgacagagcacggcggcttcttcgcgggcggctggaaaggcttcctgacggcgctgtgcatcgtggtggcgtcctatcagggcgtggagctgattggtattacggcgggcgaagcgaaaaacccgcaggtcacgctgcgcagcgcggtaggtaaagtgctgtggcgcatcctgattttctatgtgggcgcgattttcgtcatcgtcaccattttcccgtggaatgaaattggcagcaacggcagcccgttcgtgctgacctttgcgaaaatcggcattaccgccgccgccgggatcatcaatttcgtggtgctgaccgccgcgctttccggctgtaacagcggcatgtacagctgtgggcgtatgctgtatgcgctggcgaagaaccgccagctgccggcagcaatggcgaaagtctcccgtaacggcgtaccggtggcgggcgtggcgatctctatcgtcattctgctgattggctcctgcctgaactacatcatccctaacccgcagcgcgtatttgtgtacgtctacagcgccagcgttttgccggggatggtgccgtggtttgtgatcctgataagccagctgcgtttccgtcaggcgcataaagcggccattgccacccatccgttccgctcggtgctgttcccgtgggcaaactacgccaccatggcgtttttgatttgtgtactgattggcatgggcctgaatgaggacacccgtatgtcgctgtttgtgggcatcatcttcctcgccgcagtcacggtggtttataaggttttaggccttaatcgctatacgcagcctgataagctggggaaataagcagcaaaatgcgcaaagcataaccaaacgcgcattttctggagatttcttttaaaaagcactagacaggtacgcccgaagtccgtactatccacccccgcaacggcgctaagcgcccgtagctcagctggatagagcgctgccctccggaggcagaggtctcaggttcgaatcctgtcgggcgcaccatttacccggtgctggagctgcggtggcctgtgatggtagcagggccgcgtgaaagaatatcagtggtggctatagctcagttggtagagccctggattgtgattccagttgtcgtgggttcgagtcccattagccaccccattagttacaaagagtaccgtggaatgcgaaggtggcggaattggtagacgcgctagcttcaggtgttagtgtccttacggacgtgggggttcaagtcccccccctcgcaccacaaattgatttaactaaaaagtcaaaaagcagtatttcggcgagtagcgcagcttggtagcgcaactggtttgggaccagtgggtcggaggttcgaatcctctctcgccgaccaattttgaaccccgcttcggcggggttttttgttttctgcctttcctcactgttatcgcctcttttccctgttgtttcctgcttgttgcttttcggcgacgtcgccgccgatgaatgtcgcggataggagacagatatccctctgttttttaatcatatttttataatgactccattttgtcgccattaagcgacaattttcccgcgcaacatcacaaaattacctgtgacctgacgcgtaacgtgatgaaaatccaaaaatattaaaagattcagagctacgagatttagggataaaaatctggcacgggttgtgcaataatatatatgtagatgctcattccacctcttatgttcgccttagtgcctcataaactcaggaatgacgcagagccatttaatggtgcttatcgtccacagacagatgtcgcttcggcctcatcaaacaccatggacacaacgttgagtgaagcaccgatttgttgtcacacagacctgttaatgcccgttctggtttcagaacgggcatttttttatgccctctcccggtgggagagggtgacgatgggggaaattactgcggcgggttgttttgcagggtcaacagcaggccgtcacgacgcatagtggcggcttcttcaggcatatgcagacgatccagcgtatcggcaagccaggcgtagtcaaaggcatccggacgctgtttcagcgcggcgcggaacgccagactggcttctttccattcaccatgcttaagcagcgactgacccagcgtactccacaggagcggacgatcgccctgggttttgatctgctgacgcagcactttttccacctgctcaggattattggtcttcagccgtgggatcaccatgaccagccggtcgtcgtaatgacgtttcaggccatcaagcaggatctgctgggccgtgtcatgatcgtcacattcgattaaatgttcggccatcgccacctgcagcgccacctgttgacgcgttttacggctctggtttttccaccacgctttcagaccatcgctgccctgatcggcacgagcctgatccatcaacccaatccacgcctgctgtgcaagggcatcacgatgggcttcatcagcgacgtccgctttggccatagacggcagaatatcgagcagggaaccccaggcgccggtacggatatacgcctgctccgccagacgcagcacttccggatggcgcggggtgatttccagcagtcggtcgacgccgtggcgcgccgcatggttttcattgcgcgccagttgcagacgaacacgggtgatttccaccgggatctgatcgttatccgccagctccgaggcgcgctccagatgttgattggcgcgcgcttcatccccgcgctgctgggcggcttcagcggcgagcaggtagttcaccaccggctgttcagcgtgatcggcatttttcgacatcagcttttcaacctgctgataatcgccttccgccagcttgagcagtgcctgttccgtctgtttacgggcgcggcggcgtttacggccggcaaaccagccgcgggtatgtgccccggtgcgtataatgcgacgtaagatccattcgatcacaaagagtacgaccatggcgaggatcagaatgatcacaaggccggtcacactggtttcgatattgtaattgtccgtctggatcagtacgtaaccctgatgcccggcgaccatcggcccgagcacgatcccggctaacagcaatgcaaagagtaataatacttttaacatgattattctccctgcggcgcagcggcaggcgcgtcttgcgcagcctcacccgcggccgcacccggctgtgccagcagattgcgcacgcgggtctgcatcagtttttcaaggatcggctggctttgcagcgtctccggcacgttcatggtgatgctttgctggctcagcttatcaatatcgtccaggaaggctttggtgctggcatcgtcggtatcgtaataagcacgtacccagctggagacgttatccagcgcctgtttgtaagtctcttcctgatgacgtggcacagcctgggctgcgaccagcagccgcgagcgaatgttttcgcgcaggtagatgtcctggttcggcgccagcagcggcacggccgtttcatcgcgacgacgcacggtaataaagctgtccataaagttctgccagcttttttgcagattgacacgccactcgctgatggagctggacagctcgctgctgtcggaatccatcggagaatcgtcgtcgttgttgtccgccagacgcagattatcgatctggttggacagctggttcactttgaggatgatgccgtcgtaatccacctgcgcgacgccggaaaggctggcgatgtcatcagtaatggcgcggcgggcagtgatgaggctcggatcgttcatgtcggcgaggcttgcatcggcgcttttcagcagcgccgcagcggtggtgacgtcctgatcgctccacagtttgcgaccggccagtttgacgaggaaatctgcctgcgccagcagccaggttttggcgtcggtgccggaaatagtggcgactttttgctgcacgtcttcaagctgtttcgccagcgttgcctgctgacgctgcgcctcttccagctgtgaagcctgctgcttaatgatgccctcgaactgggtcttttgggtttcctgcgctttttgcagggcagtaacctgattgaccagcgcatcgctggtttcggattgtgtcgcgttctgctgtttcacccagccatacagcccaaccccggcggccagcgcgatggcaattgcaatggcgctgagcacaagactggttttattcgcgttcgcgcgttcatgttctggtgctttttctggctgtggactggtgtccaccgcctccctggtttcatcgaccacggcggagtctttctgttgttccgtcattatggcttcccattatgaaagttattgtaatgcgcgaagcagcgcatcgttgtcagcattatcagcgaccttaatgtcctgccagcccagttcccgggcgaggttcgccagacgttcgctgaccacaatcaggcggcagcgaagtaaccagttttcacgataccaggcggggatcaggtcgaaaagttgccgcagcatctcgccgctggtgatcacaatgtccgtgaccccgcgagactgccagcgcatcgcctgttccgcgccatcgtaagacttctcacagcgttgataacattcaaaaaattcgacatccgcgccccgtgacgccagcgtatccccgagcaattctcgtccgccgttgccgcgcaaaatgatggcgcgtttgcctgcaatattttgtaattcaggtaattgtagcaacacttcgctgatttcccgatccgaaggatagcgcacgttgaggctgctggcggtgtgcaatgccagcgccgtggtgcggccgatagcgaaatagtgcggcgcgtggggccagcgcaggccaagcttacgcaggtgcgcgctggcgaaggtgacggcatgttgtgaggcggcgaaaaccatatcgttcgccgtcagggcggcaaacacttccggcagcagcgccagctcccgccctggggtaaattcaatcagcgggaagctccaggccacctggccctgtgcgcacagacggctcacaagttcttccccggctggggacgggcgggtgaccagaatactcatgcgggtgcttctcctttatagacctcggtcaggatctcgcgcgcgccgttcgccagcagctcttcggcaagggaaatgcccagctgttctgcctcttcaggcttaccgcgtcgctcaccgcggatcatcacggtgccgtccggcgcgccaaccagcgcccgcaaccagatctcaccgtcgactaattcagcatagctgccaatcggcacctggcagccgccttccagccgcgtattcatcgcccgctcggcttttacgcgtagcgcggtatcggcatgattgagcggagccagcagggcatgggtgcgggtatcgtccagacggcactcgataccgaccgcgccctgaccaacggcgggcagcgacagctcaggcggcagcgccatgcggatacgatcttccagatcaagacgcttgagaccggcgaccgccagaataatggcgtcatagtcgcccttatccagcttgccaagacgggtgccgacgttgccgcgcagcgagcggatctccagatccgggcggcgttcggccagttgacactggcggcgtaaacttgacgtgccaacgatgctgcctgcgggcagggcgtcgaggctgtcataattattggagacaaaggcatcgcgcgggtcttcacgctcgcaaatggtgaccaggcccagccccttcggaaactcaaccggcacatctttcattgagtggacggccagatcggcacgattttcaattagcgccagttccagctctttaacaaacaatcccttaccgcccacttttgccagcggcgtatcaaggatcacatcgccgcgcgtcaccataggcaccagctcaacggtcaggtccggatggcacgccatcaggcgctgcttaacgtattgtgcctgccagagcgcaagggggctttggcgtgtggcaattcttaaaacattgtctaacatgcttgttaccgtcattatcgtccgttgaccatcctaacattgttgccatagggtgtcaggtttcacggaggattgcgggaaagagggacgtagccgtatttgggaatttacacataatgattgatgctacacttgtatgtagtgcatctttctttacggtcaatcggcaaggtgttagattgatcacgttttagaccattttttcgactgtactcctaaaaacacaagggcgaaaaagtggcgacgggtaattttgaaatactgaaatctgaacagttcggtgacgggaaggccatcgcaaccgcaaccgggaaggtttaaacatcaggcgatacgtcttgtacctctatattgagactctgaaacagagactggatgccataaaccaactgcgtgtcgatcgcgcgctggctgctatgggacctgctttccagcaggtatacagtctgctgcctacattgctgcattaccaccatccgctgatgccgggttacctcgacggtaacgttcccagtggtatttgcctttacacgcctgatgaaacccaacttcactatctgaacgaactcgacttgccgccgcaggatacccctccgcagggcgaactgccgatcaccggcgtgtactccatgggcagtacctcgtcggtagggcaaagctgttcctcggatctcgatatctgggtctgccatcagtcttggctcgataacgacgagcgccagcttttgcagcgcaaatgcagcctgctggaaagctgggccgcctcccttggcgtggaagtcagcttcttcctgatcgatgaaaaccgcttccgtcataacgaaagcggcagcctcggcggcgaagactgcggctccacgcagcatattttgctgctcgacgaattctatcgcaccgcggtgcgtctggccgggaaacgtattctgtggaatatggtgccgggcgacgaagaagatcattacgacgattacgtcatgtcgctttacgcgcagggcgtgctgacgccaaacgaatggctggatctgggcggcttaagctccctgtccgccgaagagtacttcggcgccagcctgtggcagctgtataaaagcatcgattccccgtacaaagcggtgctgaaaacgctgctgctggaagcctattcctgggaatatccgaatacccgcctgctggcgaaagatatcaaacagcgtctgcacgacggcgagatcgtctcttttggtctcgatcactactgcatgatgctggagcgcgtgaccgcctatctgacggctatcgaagattttacccgtctcgacctggtacgccgctgcttctacctgaaagtatgcgaaaaactgagccgcgaacgcgcctgcgtgggctggcgtcgtgaagtggtcagttcgctggtgaaagagtggggatgggacgatgagcggcttgccatgctcgacaaccgcgccaactggaaaatcgaacaggttcgcgaagcgcacaatgaactgctggatgcgatgatgcaaacctatcgcaacctgatccgtttcgcgcgccgcaataatttaagcgtttccgccagtccgcaggatatcggcgtgctgacgcgtaaactgtatgccgcctttgaagcgctgccgggcaaagtgacgctggttaacccgcagatttcaccggatctttcggaaccgaatctgacctttatccatgtgccgccgggccgtgccaaccgcgctggctggtatctctacaaccgtgcgccaagcatggacgccatcatcagccatcagccgctggaatataaccgctatctgaataagctggtggcctgggcgtggtttaacggcctgctgacttcacgcacccggttgtttattaagggcaacggcgtggcagatctggcgaagctacaggaaatggtggcggatgtgtcgcaccacttcccgctgcgtttacccgcgccgacgccgaaagcgctctacagcccgtgtgaaattcgccatctggcgatcatcgtcaatctggaatatgacccgacggcggccttccgcaatcaggtggtgcattttgatttccgtaagctggatgtgttcagcttcggcgagcagcaaaactgcctggtgggcagcgtcgatctgctttatcgcaactcatggaatgaagtgcgtaccctgcacttcaacggcgagcaggcgatgatcgaagcgctgaaaaccattctcggcaaaatgcatcaggacgccgcgccgccggacagcgtcgaggtgttctgctacagccagcatttgcgcggtctgatccgtacccgcgtgcagcagctggtgtccgagtgcatcgaattacgcctctccagcacccgtcaggaaaccgggcgcttcaaagcgctgcgcgtggcggggcaaacctggggactgttctttgaacgtctgaacgtgtcagtgcagaagctggaaaatgccatcgagttttacggtgccatttcccacaataaactgcacgggctgtcggtacaggtcgagaccaatcaggtcaaactgccgccggtggtggatggttttgccagcgagggcattattcagttcttcttcgaagcctcggcggataacaacggctttacgatctacatccttgatgaaagcaaccgcgcagaggtgtatcaccactgtgaaggcagcaccgaggaactggtacgcgacgtcagccgcttctactcctcgtcgcacgatcgctttacctacggctcaagctttatcaacttcaacctgccgcagttctatcagattgtgcaggtgaacgggcgcgcgcaggtgatcccgttccgcaatcagacaatcagcgccgttcctcctgccaatcaggatgacgacgctccgctgttgcagcagtatttctcttaacggaagctgaccgcttcgcccgcttgctgcgtggcggcctgctccagcagatcccagaagcgctcgccgctgcgatcgcaaatccactcatcgccctgcaaatcaaaatggtagccgccctgtttggtcgccagccacacctgatgcagcggctcctgacggttgataataattttgctgccgttgtcgaacgtcagggtcagcacgccgccgttgatttcgcagtcaatatcgccgtcgccgtcccactcatccagacgggtttcaatggtctgccacaggttatcggccaggcgatggaattctgaatcgttcattttttttcctttttttcgtgatgccgggagtataacgcgaaacaattcccaatgcaggaggtgcgcaaactcttgcttttgcggcttctcctgcgatgatagaaacagcaagcatgaacttacaggcaaaccataatgaagaatgtgttccgaacgctttttgttttcgttgcgttatgcagtctggccggctgtggtctgaaaggcccgctctatttcccgccagccgataagtcagcgccgccgccgaccaaaaaggtagaaagcaccgagcaagaactgacgccgacgcgtaacgatcgtggcaacaatgacggccctactcaggtaaattactaacagattttattctgtaaccgcgggaatggagtagatgatgcagttctctaaaatgcatggccttggcaacgattttatggtcgtcgacgcggtaacgcagaatgtctttttttcgccagagctgatccgccgtctgtccaaccgacatctgggggtgggttttgatcaactgctgatcgtcgaaccgccttacgatccggatctcgattttcattaccgcatctttaacgccgatggcagcgaagtctcccagtgcggtaacggtgcgcgctgtttcgcccgctttgtgcggctgaaagggctgaccaataaacgcgatattcgcgtcagcacggccaatggccgcatggtgctgagcgtcacggaagatgagctggtgcgcgtgaatatgggcgagccaaactttgagccgtccgcggtgccatttcgcgccaacaaagcggaaaagacctatattatgcgcgttgccgagcagactattctctgcggcgtggtttctatgggcaatccgcactgcgtcattcaggtggatgatgtcgacagcgcgccggtggaaaccctcggcccggccatggaaagccatgagcgcttcccggagcgggctaatatcggctttatgcaggtagtaaagcgcgaacagatccggctgcgcgtctttgagcgcggtgccggtgaaacccaggcctgcggcagcggcgcttgtggggcggttgcggtcggtattcagcaaggcttactggcggaagaggtgcgcgtggatttaccgggcgggcgtctcgacatcgcctggaaggggccgggccatcctctgtatatgactggcccggcgacacatgtttacgacggatttattcatttatgaagcagacaggggaagaacagcaggaggcgacggccacactcaatgacagtgatgtggtggattatctgctgcgcgatcctgagttctttatccgtaatgcgcgcgccgtggaactcctccacgtgccgcacccggtgcgcggcgccgtctctctcgtcgaatggcagatggcgcgcgcccggcatcacatcaatgtgctcgaagagaatatgacgctgctgatggagcaggccagcaccaacgaaagcctgtttaaccgtctgctgcgtttgcagggccgtctggcgtccgccagcagccttgaggatttgctcaaccgttttcaccgctggtcgcgtgaaatgggcctggcgggggcgagcatccgtttatttcccgatcgctggcgcattggcgcgccgtccggcttcacccatctggcgctgagccgtcaggcctttgagccgctgcgtattcagcgccttggtcatgaaaatcactatcttggtaccctgaacggcccggaattactggtgatactccctgacgcgaaagccatcggctcggtggcgatgtcgatgatggggcgtgacggcgatcttggggtgatcctcttcagcagccgtgacgtgcaccattatcagcaagggcagggaacccaactgcttcaggagattgccctgatgctgccggagctgctggagcgctggatcgagcgcatatgaacgacacctctcttgaccatgcggtaagccgttttctgcgctacctgggcgttgagcgccagctcagccccattaccctgctcaactaccggcgtcagctcgatgccatcatggcgatcgcccgtgaaaccggtattacccgctgggcagattgcgatgccgccagcgtgcgcaccattgcggttcgcagccgtcgtcatggcctgggcgcggccagccttgcgctgcgcctgtctgccctgcgcagtttcttcgactggatggtgtcgcagggtgagttgcccgccaatccggcaaaaggcatcgccgccccgaaagccccgcgtcatctgccgaaaaatattgatgtcgatgacgttaaccgcctgctggatatcgatctcaacgatccgctggcggtgcgcgaccgggcgatgctggaggtgatgtacggcgcgggtctgcgtctgtcagagctggtcgggcttgatatcaaacatctggatttatcaaccggcgaagtatgggtgatgggtaaaggcagcaaagagcgccgtctgccgattggccgtaacgcggtaagctggatcgagcactggctggatctgcgcggcctgtttggcagcgatgaggacgcgctgtttttatcaaagcttggcaagcgtatctcggcgcgcaacgtgcagaaacgctttgctgaatggggtatcaagcaggggctgaacagccatgttcacccccataagctccgtcactcctttgccacccatatgctggaatcgagcggcgatctgcgcggcgtccaggagctgctggggcacgcgaacctgtccaccacgcagatctatacccaccttgattttcaacatcttgcctcagtgtatgacgcggcgcatccgcgcgccaaacgggggaaataatgcgtttttaccgtcctttgggccacatttcggccctgacgttcgatctcgacgacaccttgtatgacaaccatccggtgatcctgcgtaccgagcaggagtcgctgaccttcgtacaaaattaccatccggcgctgaaggcgctgcaaaagagcgattttcagcagctgcgccaggcgttacgcgaaagcgagccggatatttatcacgacgtaactgaatggcggcgtcgggcagtgatgcaggcgatgctgaacgccggactgaacgcggaagaagccgatgccggcgcccgtgccgccatggaaaacttcgcccactggcgcagccgcattgatgtgccgcaggccacgcacgacgctctggcggcgctgggcaaaaagtggccgctggtggccatcaccaatggtaacgccgagcctgaacggttcggtctgggtgattactttgcgtttgtgctgcgcgccggtccgcacggccgctcgaaacccttcagcgatatgtatcagctggcggcggaaaagctcggcgtgcccgcaggggagatcctgcatgtgggcgatgacctgaccactgacgtggccggggcgatccgttatggcatgcaggcgtgctggatcaaaccgcaaggggccagcctgatgaccgccacagacagccgtttattgccgcaccttgaaatttcgcagttggcatctctgacctcgctgatataatcaccaatagttctgtataaaataccagggttttggcggatggcgctctgcttatccgccctgcgataacgcagacccggtaagcgaagcgccatcgggcaattcgttctgtttctgattactacgtggcggtgccaatggacgtttcttacctgctcgacagcctcaatgacaaacaacgtgatgcggtagccgcctcgcgcaccaatatgctggtgctggcaggcgcaggcagcggtaagacacgcgtgctggtccaccgtatcgcctggctgttgacggtagaaaactgctcgccgtactccattatggcggtgaccttcaccaacaaagcggcggcggaaatgcgccaccgtatcagccagctgatgggcaacagccagggcggcatgtgggtcgggacgttccacggcctcgcgcaccgtctgctgcgcgcgcaccatatggatgcgaatctgccgcaggatttccagatcctcgacagcgaagatcagctgcgtctgttacgtcgcctgatcaaagccatgaacctcgacgagaagcagtggccgccgcgtcaggcgatgtggtacatcaacggtcagaaagacgaaggcattcgtccgcatcatattcaaagcttcggcaacccggtggagcagacatggcagaaagtctaccaggcttaccaggaagcctgcgatcgcgcagggctggtggattttgccgaactgctgctgcgcgctcatgagctgtggctcaataagccgcacatcctcaaccactaccgcgagcgcttcaccaatattctggtggacgaattccaggataccaacaacattcagtacgcctggatccgcctgctggcaggcgataccggtaaggtgatgattgtgggcgacgatgaccagtccatctacggctggcgcggcgcgcaggtggaaaacattcagcgcttcctgaacgacttccctggcgcggaaaccattcgtcttgagcagaactaccgctctaccaacaatattctgcgtgccgccaacgccctgattgaaaacaacaacgggcgactggggaaaaagctatggactgaaggcattgatggcgatcccatctccctttactgcgccttcaacgaactcgacgaagcgcgtttcgtggtgaaccgcatcaaggcctggcaggaaagcggcggcgcgctggagcagtgcgccattctctatcgcagcaacgcccagtcgcgcgtgctggaagaggcgctcctgcaggtggggatgccgtatcgcatttacggcggcatgcgcttcttcgaacgtcaggaaatcaaagacgcgctctcttatctgcgtctgatcgccaatcgtaacgacgacgccgcctttgaacgcgtggtgaacacccccacgcgcggcataggcgaccgtacgctggacgtggtacgtcagacctcgcgcgaccggcagctgaccctgtggcaggccagccgggaattattacaggagagagcccttgcgggccgcgccgccagcgcactgcaacgctttatggagcttatcgaagcgctggcgcaggaaacctccgacatgccgttgcacgtgcaggcggatcgggtgatcaaagattccggcctgttcatcatgtatgagcaggagaaaggcgaaaaaggccaggcgcgcgtcgaaaacttagaggaactggtgacggcaacgcgccagttcagctacaacgacgaagaagaagatctgatgccgttgcaggcgtttctgtcccacgcggcgctggaagcgggcgaagggcaggcggatacctggcaggatgcggtgcaactgatgacgctgcactccgcgaaagggctggagttcccgcaggtgtttatcgtcggcgtggaagagggcatgttcccgagtcagatgtcgctggatgaaggcggccgtctggaagaggagcgccgtctggcctacgtgggcgttacccgcgccatgcaaaaactgaccatcacctatgcggaaacccgccgtctgtacggcaaagaggtttatcaccgcccgtcacgctttatcggcgagctgccggaagagtgtgtggaggaggtgcgtctgcgcgccagcatcagccgtccggtgacgcacaagcagttaggtacgcccatcacccaaagcgattccggctttaagctgggacagcgcgtgcgccatgcaaaattcggcgaaggtacggtggtgaatctggaaggcagcggcgagcacagccgtctgcaaatcgcgttccccggtcagggcatcaaatggctggtagccgcctatgcgaagctggaaacggtgtaacattcagaaaaatatcataattttgtaatattctgctagccttataccgggaaggttaattaatatcctcagccgttccgttgcgtgttgacgccatttttctgctggcgtaacatgcgcgcacgattacgctaagaggacattcgccttggacacacccagtagatgctggctcaattccctgtcatccaggaacaactcctaaggctatctcctcgcgctgatggccttagtggttgtcagcgaccgcattttttacccgtcgcactgagtcaggctgtttaatggtctgaaacccaatttgtttctgtgtgcccaccgaactgtccgataatttttgcattgggagtcccggtcatgctgagcgcatttcaactggaaaataatcgcctgactcgtctggaagcggaagagtcacaaccccttattgacgccgtttgggtggatctggtcgaaccggatgacgatgagcgacaccgcgtacagtccgaactggggcaaagcctggcgacccgccccgagctggaagacatcgaagcctcggcacgtttctttgaagatgaagacggcctgcacattcactccttcttcttttttgaagatgcggaagatcacgccggtaactccaccgtggcgttcaccattcgcgatggccgcctgtttaccctgcgtgaacgtgaactaccggctttccggttataccgtatgcgcgcccgcagccaggcgatgatcgacggcaacgcctacgaactgctgctcgatctgttcgaaaccaaaatcgaacagctggcggatgagatcgaaaacatttacagcgatctggaaaagctgagccgcgtcattatggaaggccagcagggcgatgagtacgacgaagcgctgtcggcgctggcggagcaggaagatatcggctggaaggtacggctgtgcctgatggatacccagcgcgcgctgaacttcctggtgcgcaaggcgcgcctgccgggcggtcagctggagcaggcgcgtgagatcctgcgcgatatcgaatccctgctgccgcacaatgaatccctgttccagaaagttaacttcctgatgcaggcggcgatgggctttatcaatatcgagcagaaccgtatcatcaagatcttctcggtggtgtccgtagtgttcctgccgccgacgctggtggcttccagttacggtatgaactttgagtttatgccggagctgaaatggagcttcggctatccgggggcgatcattctgatgatgctcgcgggactggcgccctatctgtacttcaagcgccgtaactggctgtagtgtttatgccggatggcgcttcgcttatccggcaaaacatcacaaccctttccgaaccctgcgctgcgtatagagcgcatccatcacaaacaccgccagcgccacccagataaacccgaaggtgaccatcttatccgcgcccggcacttcgccgtaaaacagcaccgccagcaggaacatcagcgtcggcccgatgtactggaagaagcccagcgtggacaggcgcagacgcgtcgccgcgccggtaaagcacagcagcgggattgtcgtcaccacgcccgccgccatcagcaacagattcagcgaccacgggttctgcgtcatatggctggtggcggtatcggcgatgccgaacagccagatggcggcgaccggcagcagccacagcgtttcgatcagcatgccgatttgcgcgtcaacggcgatctttttacgcaccaggccataaaacgcaaagctgaaggccaggcccagcgcgatgatcggcagcgagccaaaggtccacagctgcaccagcacgccgcaaccggcaagcagcaccgccagccactgcatacggcgaaaacgctcgccgaggaaaatcattccgagcagaatattcaccagcggattaataaaatagccgaggctggcttccagcagatgatggttattcaccgaccagataaacagcagccagttgccgccaactaacaccgccgacagagccagcagcaggatttttttcggctggctgaggagcttcttcagctgcgaccactgacggcttacgctaatcagcgccaccatgaaaaagaacgaccagataatgcggtgggtcagaatttcactggcgggaacgaaatcgatcagtttgaagtaggccggtgcgataccccaaataaaataagcggcgagggcgagtaataccccctgccgcgtctgctttgcatccatgggtacatccaacatctgttactaaaaagtaacgacattttacccgatctctgccgctcaacctaccatatacgtcgccgtggcggtggcgatatgcagctgttcttcattgtgcagttcaacgcgggcgactgacactttattaccggcgcgcagcaaagtactggaggcggtaaaacgatttccccggcccggacgcagataatcgacgcgcagatcgatagtgcccatgcgcgacaggcgctggcgaagctcatcttcgctgatcgtatcgtgacgcgttaaggtgctgccgacgcacaccagccccgcggcgacgtccagcgacgaggcgattaccccgccgtgtaaaatgctctgcgcccagttacccaccatcatcggctggttgttaaaactcagctgggcaaagtctttttcgtagcgttccagctccagtcccagcgcgcggttgaagggcatatgataaacaaaaatctcaccgaccagctgtaacgcttcatcggctgtaaggacggctgacataatcacctgatccattggttaaagaaatgttgattttatgcttcgccaatgttgatttccactttcagaaacgataactgcgcagttaattaataaatatgtagaatgggcgtctgattattattcacccctattttttgttcaggagagcaagaccgatgcggacgtttctgggttggtttctggcggccgttgcgctgccgtttacagcatttgcgcaggaagcgacggttaaagccgtgcatgacgccccggcagtgcgggggagtatcatcgccaatcttttacaagagcacgataatccttttacgttgtatccgtatgaatcgaactatgccatttacacggccaccagcgatctgaacaaagaggcaatcgaaacttacaactgggcgaaaaactcacgcaaagatgaagtgaagtttcagttgagtctggccttcccgttctggcgcgggatcatggggccgaactcggtgcttggcgcatcctatacgcagaaatcctggtggcagctctccaacagcggcgagtcatccccgttccgcgaaaccaactacgaaccccagctgttcctcggctttgccaccgactacgagctggctggctggacgctgcgcgatgtggagtttggttttaaccacgactctaacggtcgctccgatccgacatcccgtagctggaaccgtgtttatacccgcctgatggcgcagaacagtaactggctggtggaagtgaagccctggtacgtggtgggcgataccgacgacaacccggacatcaccaaatatatgggttactaccagctgaaagtgggttatcagctgggggaagctatcctgagcgcaaaagggcaatataactggaataccggttacggcggcgcagaactgggcgtgagttatccgatcacccgccatgtccgtctttatactcaggtttatagcggttacggcgaatcattaattgattacaactttaaccagacgcgtgtcggcgttggcgttatgctaaacgatctgttctaaggcattgcagtttcactcgcaggcgctgaaaatagcgcctgtttttatttcaggtaaatggggtagatgtggcgcaggcggaagtaatgaatcaggcatcgctggcgaaacaggtcttgcaggaaaccttcggctatcagcaattccgccccggtcagcaaacaatcattgataccgtgctggaaggccgcgactgtctggtcgtgatgcccaccggcggcggcaaatccctgtgctatcagatcccggcgctggtgctggaagggctgaccattgtcgtgtctcctctgatctcgctgatgaaagaccaggtggatcaactgctggcgaacggcgtggccgccgcctgtctgaactcgacacaaacccgcgagcagcagcaagaggtgatggcaggctgtcgcaacggtcaaatccgcttgctgtacatcgcccctgaacgcctgatgctggataacttccttgagcatcttgctcactggaacccggcgctggtcgccgtcgatgaagcgcactgtatttcccagtggggccacgatttccgcccggaatacgccgccctggggcagctgcgtgcgcgcttcccggcgctgccgtttatggcgctgaccgccacggctgacgacaccacccgccatgatattgtgcacctgctgggtcttaaggatccgctgatccaggtcagcagcttcgaccgcccgaacatccgctatatgctgatggaaaagttcaagcccctcgatcagctgctgcgttatgtgcaggatcagaaaggcaaatccggcattatctactgtaacagccgcgccaaagtggaagacactgccgcccgtctgcaaagccggggtttcagcgccggagcctatcatgccgggctggaaaacagcgttcgcgccgaggtccaggagaagttccagcgcgacgatctgcaaatcgtggtggcgacggtagccttcggcatgggcatcaacaagccgaacgtgcgctttgtggtgcatttcgacattccgcgcaatatcgaatcctactatcaggaaaccggtcgcgccgggcgtgacggcctgcccgctgaagccatgctgttttacgatccggccgatatgggctggctgcgtaaatgtctggaagagaaaccgcccggccagttgcaggatatcgaacgccacaagctgaacgccatgggggcgttcgcggaagcacaaacctgccgccgcctggtgctgcttaactattttggtgaaggtcgtcaggagccgtgcggcaactgcgatatttgcctcgatccgccgcgccggtacgacgggctgatggatgcgcaaaaggcgctgtcggcaatttaccgcgtcggccagcgcttcggtatgggctatgtcgtggaagtgctgcgcggcgcgaataatcagcgtatccgcgaactgggtcatgacaaacttaaaatctacggcgaagggcgcgaccatacgaccgagcactgggtcagcgtgatccgccagctgatccatcttggcgtggtgacgcaaaatatcgcccagcattcagcgttacagcttaccgaggccgcgcgtccgttcctgcgggcggaagtcccgctgcagctcgccgtaccgcgcgtggtggccattaaagcgcgtaataacccgaaagtcttcggcggcaactatgaccgcaagctgttcgccaaactgcgcaaactgcgtaaggccattgccgatgaagagaatatcccgccgtatgtagtgtttaacgatgcaacgctgattgagatggcggagcagacgccgatcaccgccagcgaaatgctgagcgttaacggcgtggggatgcgtaagctcgaacgttttggcaaagagtttatggcgctgatccgttcgcatgtcgatggcgacgatgacgagtagtcaagcacgtaaaaaagtgtcaggatgagatcctgatcatttatttccccgcgagcgagttatgttaatgctgtttttgaccgtggcgctggtgcatatcgttgcactgatgagcccgggaccggatttcttttttgtttcacagactgccgttagccgttcacgtaaagaagccatgatgggcgtgctgggcatcaccacgggcgtgatggtctgggcgggcgtggcgctgcttggcctgcacctgatcctcgaaaaaatggcgtggctgcataacattattatggtcggcggcgggctgtatctgtgctggatgggttaccagttgttgcgcggggcgctgaaaaagcaggacagcagcgcaccgacgccgcaggtggaactggcgaccagcggacgtagtttcctgaaaggtctgctgactaatctggcgaatcccaaggcgattatttacttcggttcggtgttctcgctgtttgtcggcgataacgtcggctccgcggaacgctggggcattttcgtactgatctcgctggaaaccttcgcctggttcaccgtcgtggcgagcctgttcgcgctgccgtcgatgcgtcgcggttatcagcggatggcgaaatggatcgatggcgttgccggcgcgctgttcgcgggcttcggcattcatctgattatttcccgctaacttttccccacccggcataaaagacgggtgggtgatttttagtggcaaaggtgctgcaactcgtcctgcgtcaggccggtcatatccataatcgcgtctttgtcgaagcccttttgcagcatctgtcgcgcaatctcctgtcgagcagcgcgttgtccttcgaggatcccttgttgtagtccttgctgtatcccttgctgtagtccttcccgaattccttcctgtattccctcttgtatcccttgcaggagtccttctgtccgccccatcaattttaactgttcagcgattgtcatcagcttgtctccttgttgtggcacgcggcgcgccagttcatacaataacgttttcacgtcatgcgtttctcctgcctgaatcatatattttatcagtaccgcaatttgttgtccgctcatgtgcttttcccgcagcaggttggcgagtctgtctagcagcagggctatatcacgctggcggatatgcttctggatcagggtcagcgccgccatgctgcgatgttgcatgatttcctcatcggggatcaccgtaatgtccaccagcgggaatgggctactgtagagctgccgggccagctgcggctgttgaaagtcgtccagccagttcaggctccagggccaggggctgcgtcgcccctgatagaaaagcaccgggatcaccagtggcagagtggaatgcccggcctccaggtggcgctgcatggcggccaccgcgtagcgcatcaaccggaatgccatatgtttatcgggcgagctttggtgctcgataagcacatagatatagccatcaccactggtcgtctttagcgaataaagaatatcgctgtagtagggatgcaaatcgtcttcgacaaaactgccggattccaggcgcagcgtatccagatcgcagagcgttctcaggtctggcggcaggtgaatgtcaataaaatcccgcgcggtttccacgcgggagaggaaggttttgaataccgaatcatggggtgtcgcagcttgcgccatgttatgccgtccgtggtgacttcaatggcggcattctggcactgcgacaaaacaaaatttgcgagccgctttcccgatttacttacgcatgacgggtggaggccagcagcgcgcccaccagcacaaacagcgatccaaagatccggttgagcgctttcatctggcgcgggcctttgatccatgacgcaatccgcgtcgccagcgtggcgtatccaatcatcacaataatatccaccacgatggtggtggtgccgagcaccacgtactgcatgatttgcggctgatgcggcacgataaactgcgggaagagcgcggcaagaaacacaatgcttttggggttggtaaggttcacaaacaccgcccggcggaacagatgcccacgcgactgggtgctcgccagcgtattgagatccagtgcccccgccgcgcgccactgctgaatacccagccataccagataggccgcgcccgcccacttcagcacttcaaaggccattacagaacgggagaacagcgtacccagaccaatacccaccagcacgatatgaatggcaagtccggtctgcagaccgctgatggaggccgccgcgccgcgatagccgtgcgtcatggcggtagtcatggtgttgatcgccccggagcccggcgacaggctgaggataattgacgtgatgaggtaagcgaaccaccattcgaaggtcatgtgaaactccctggatgacattttttatgccacaataccttggtgtttgggtacggtgtagcgcggcctgaaaaaacgataatacacggcagtcgggggttcagacccaatgtttcggcagaaaatggactgggaaacaagagaaaacgcgtatgcggccttcactcacggaccgctgaccgatttctggcgtcagcgcgaggaagccgaaatcatcggcgtcgataatatcccgatccgctttgtgcgctttcgcgcgctcggccacgatcgggtgattgtcgtctgccccggacgcatcgaaagctacgtgaagtatgccgaagtggcgtacgatctgtttcatctcggttttgacgtattgatcatcgatcaccgcgggcaggggcgctccgggcgtctgctttccgacagccatcgcggtcacgtcgataattttgatgattacgtcgacgatctggcggctttctgggcgcaggaagtgacgccaggcccgtggcgcaaacgctacattctggggcattccatgggcggcgcgatctccacgctgtttctgcaacgcacgccgcaggcctgtgatgccatcgccctgaccgcgccgatgtttggcattgttatccgtctgccggactggatggtgcgacacattcttgactgggccgaaggcaacccgcgtatgcgcgaaagctacgccatcggcaccggacgctggcagccgctgccctacagcctcaacgtgctgacccacagccgggaacgctaccggcgcaacttgcgcttttatgctgacgatccgcagctgcgcgtcggcgggccaacgaatcactgggtacgggaaggaatacgcgcgggcgagatggtgctggaaggcgccgccaacgacgccacgcccatgctgcttatccaggcagaagaagagcgggtagtggataaccgcatgcacgatcgttattgtgaaattcgcgccgcagcgggccatccctgtgaaggaggcaaaccgctggtcattaatggcgcttaccatgagatcctttttgaaaaggacgctatgcgctcagtcgcgcttaacgccatcgtcgattttttcgacaggcataactcacccggcgggtctcccgctttgtccagaggttgaattttcttatgtatcaggttgttgcgtctgatttagatggcacgctgctctcgcccgaccataccctttccccttatgcgaaagagacgttaaagctgctgaccgcgcggggcgttaactttgtcttcgccactggccgtcaccacgtcgacgtgggccagatccgcgataatctcggcatcaaagcctatatgatcacctccaacggtgcgcgtgtgcatgataccgatggcaatctggtcttcactcataacctggatcgcgatattgccagcgacctgtttggcgtggtgcatgcgaacccggatattctcaccaacgtctaccgtgacgacgaatggtttattaaccgtcatcgtcccgatgaaatgcgctttttcaaagaggcggttttcagctattccctctttgagccaggcctgctggacgccgacaacgtcagcaaaattttcttcagctgcgaaagccatgaaaagctgctgccgctggagcaggcgatcaacgcccgctggggcgatcgcgttaacgtgagtttttccacgctcacctgtctggaagtgatggcgggcggcgtctcgaaaggccacgcgctggaagcggtatccaaagcgatgggctatggcttagcggattgcatcgcctttggcgacggcatgaacgacgcggaaatgctctcgatggccggtaaaggctgcattatggctaacgcccaccagcggctgaaagatctgcatccggagctggaagtgatcggcaccaacgccgacaacgctgtgcccaattacctgcgcaagttgtttctcgattgattaaatagcaatcagttgtcaaccatgaagtccgctacaatgaatgctcattaatcaaagagacattcattgtggcgttactgatcatcaccaccgttctgtgggcgttttccttcagcctgtttggcgaataccttgccggtcacgttgacagctatttcgccgtgctggtgcgcgtcggcctcgcggcgctggtctttttaccttttctgcgcacccgcgggcacgatctgaaaaccattgcgctctatatgctggtgggcgccatgcagctcggcatcatgtatatgctgagcttccatgcttatctgtacctgacggtttcggaactgctgctgttcaccgtgctcacgccgctgtacatcaccctgatttatgatctgatgagcaagcgccgcctgcgctggggctatgcatttagcgccctgctggcggtgattggcgcagggatcatccgttacgatcaggtcaccgatcacttctggatgggcctgctgctggtgcagctgtcaaacatcagctttgcgctgggaatggtgggctataaacgcctgatggaaacccgtccaatgccgcagcataacgcctttgcctggttctatatgggcgcgttcgtggtggcggcgatcgcctggtttatgatgggcaacgcgcagaaattaccggaaaccacgctgcaatggggcattctggtgtttcttggcgtggcagcctccggcattggctacttcatgtggaactatggcgccacacaggtggatgcgggcacgctgggcatcatgaacaatatgcatgtgcccgccggtctgctggttaacctggcgatctggcatcagcagccgcactggcccagctttattattggtgggtcggtgatagtggcttcgctgtgggtgcatcgccggtgggtcgctccgcgctccgcacaaaaggaagatgatcgcaggcatggttccgcgctgagcgaataaaggcttccgttaccggctgacgctgctcgccatcgcgcacggcggcgtacagccggctccacaatccctcgcccagggttttggtcacgatcaggccctggcgctcaaaactctccaccacccagtgcggcagcgccgcgatgcccatttttgccgccaccatctggatcagcagcagcgtgttatcgacgcttttcagcgccggggtgatgcctgccggttgcaggaaatgccgccagatatccagccggctgcgctgcaccggataaatcagcagcgtttcgcaggctaaatcttccggcgtaatacgcgcttttgccgccagcggatgatccggggccagcaccagccgcacttcaaaatcaaacatcggtgaatagtgcagaccgctgcgcggcagaatatcggaggtcagcaccacgtccagttccccctgttgcagcgcgggctggggatcgaaggtcacgccggatttgaaatccatctccacctgcggccatttcgcgcggaaattttccagcgccggggtcagccactgaatgcagctgtggcattcaatggcaatgcgcagcgtcgtttgctgcggctcgttgcagtcctgaagcgcccggctgatttgcggcagtacctgattcgccagctgtaacaggatctcgccctgcggcgtaaagcgcagcggctgactcttacgcacaaataaccgaaagccaaggcgctgctccagatcgctgaactggtgggagagggcggattgcgtctgatgcagcgtggctgccgccgccgccagcgatccgctattccgtaacgcctgtagcgttttcagatgtttaatctcgatcatgaaagtccttcactccggcatgaacaatttgcgcttgaggaatatacagtaactgccaattatagatgtgtaaacatctggacggctaaaaatccaatgtcttttaaatttatggtgcgttggctgcgttcactcaccccggtcacttactgatgtaagctcccggggatgagcaaacttgccgccttccctaaattcaaaatccacaggatttataattcattagaggaagaaattatgacaattcgcaaccacaccctcggtttccctcgcgttggcctgcgtcgcgagctgaaaaaagcgcaagaaagctactgggcgggtaacaccagccgtgaagaattactggcggtggggcgcgaactgcgcgcccgtcactgggatcaacaaaaacaggcgggtatcgatctgctgccggtgggcgatttcgcctggtacgaccatgttctgaccaccagcctgctgctcggcaacgtgccggctcgtcatcagaacaacgatggatccgtcgacatcgacaccctgttccgcattggccgtggccgtgcgccgaccggcgaaccggctgcggccgcagaaatgaccaaatggtttaacaccaactatcactacatggtgccggaattcaccaaaggccagcagttcaaactcacctggacgcagctgctggaagaggtggatgaagcgctggcattgggccataacgtcaaacctgtgctgctggggccggtgacgtacctgtggctcggcaaagtgaaaggcgagcagtttgatcgtctgagcctgctggacgatattctgccggtctatcagcaggtgctgggcgagctggcgaaacgcggcgttgagtgggtgcagattgacgaaccggcgctggtgctggagctgccgcaggcgtggctggacgcctttaaaccggcctacgatgcgctcaccggacaggtcaaactgctgctgaccacctattttgaaggcgtgacgcctaacctcgacaccatcaccgcgctgcctgtgcaggggctgcatgtggatctggtacacggcaaggatgacgtcaatgaactgcatcgccgtctgccgtccgactggctgctgtccgccggtttaattaatggccgtaacgtctggcgtgccgatctgacagagaaatacgcgcagatccagccgattgtcggtaaacgcgatctgtgggtggcgtcgtcctgctcgctgctgcacagcccgatcgatctctcggtggaaacccgccttgatgcggaagttaaaagctggttcgcctttgcgctgcaaaaatgtgaagaactggcgctgctgcgcgatgcgctgaacagcggcgatacggtaaaactgacagaatggagcgccccgatccaggcgcgtcgcagttcagcgcgggtacataaccccgccgtggagcagcgtctggcggccatcaccccgcaggacagccagcgccagagtgcttatgcagaacgcgcaaaagcccagcgtgaacgcttcaacctgccggcgtggccgacaacgaccatcggctccttcccgcagaccaccgagatccgcggcctgcgtctggatttcaaacagggacgtttggacgcgggcaattaccgcaccggcatcgccggacatatcaaacaggcgattgccgaacaggaacgcttagggctggatgtgctggtgcacggcgaagccgagcgtaacgacatggtggaatactttggcgaacacctcgacggcttcgtattcacgcaaaacggctgggtgcagagctatggctcccgctgcgtaaaaccgccagtggtgattggcgacgtcagccgcccggaagccatcaccgtggagtgggcgaagtacgcccagtcgctgactgacaaaccggtaaaaggcatgctgaccggcccggtgaccattctctgctggtccttcccgcgtgaagacgtcagccgtgaaactatcgctaaacagatcgccctggcgctgcgtgatgaagtggcggatctggaagcggcgggcattggcatcattcagattgacgaaccggccctgcgcgaaggtttaccgctgcgccgcagcgactgggctgactacctggcatggggcgtcgaagccttccggattaacgccgccgtggtacgcgatgacacacagatccacacccacatgtgttactgcgagtttaacgacatcatggattccattgccgcgctggacgccgacgtgatcaccatcgaaacctcgcgttctgacatggagctgctggagtcctttgaagagttcgagtacccgaacgaaatcgggccgggcgtgtatgacattcactcgccgaacgtgccgagcgtggagtggatcgaagcgctgctgaaaaaggcggcgcagcgtgtaccggcggagcgtttatgggtgaacccggactgcggcctgaaaacccgcggctggccggagacccgcagcgcactggcgaacatggtgaaagcagcgcagaacctgcgcacggcgtgagtatattcccctctcctgaacaggagaggggcaaatttattacagcgactgatctttcgtttcgtgcgtaaggatcagcgcgattaacgtcagaccggccatcgcggccagatagatgccgacatagaacaggccataattggcggtcagccaggcggcgatatacggggccacagacgcgccgagaattgacgacacgttataggagaacgacgcgccggtataacgtacttccgtcgggaacagctccggcagcagcgcgcccatcgggccaaaggtcaggcccatcagactcagacccagcagcagatacaccattaccagcgcctggcttccggaacccagcagcggcgggaaggcaaacagcgcaaaaataatgatcatcgaggtaatggcaatcattgatttacggcgaccataagcatcagccagcagaccggctaccggcaccattacgccaaaaccaattaccgccagcatcagcatccacagcacttcattacgcggcatccccagtcccacaggcgcaggcgtggtgctgtaggtcattgagtaaaccgtcatgatgtaaaacagcgtataggtcgccagcatgatgaaggtgccgagaatggtgacgcgcagatgtttcgtcagcagcgtacccagcgggatcttcacctgttttttcgccgcggcgactttagcaaacaccggcgactcatgcagcgacacgcgcacgtacagaccgatgagcaccagcacggcagagaaaatgaagggtacgcgccagccccagctcatgaactgctcgtcggtcagcagccaggagagcagcaggaaggtgccgttggcaaagaagaagccaatgggcgcgccgagctgcgggaaggagccgtacagggcgcgtttacgcggcggcgcattttctgtcgccagcaacgccgcgccaccccactcaccgccaaggcccaggccctgaccaaaacgcgccagcgccagcagcagcggggcgaaaatgccgatggtttcatagcccggcagcaggccgatcagcaccgtggaaatccccatcgtcagcagtgacgccaccagcgtggttttacgtcccacgcgatcgccaaagtgaccaaataccgccgagccaatcggacgggcgataaaggcgatggcgaaagtggccagcgactgtagcgtggccgctgtcggatcgccctgcgggaagaagatatgtggaaagacgataaccgccgcggtggcataaatataaaaatcgaaaaactcgatggcggtgccaatcagggaggcaacaacgaccttattgcgtgagtttaccggcgggctttcctgctcattgtcgagggttgtggctgtagcttgcatagatatttcttattttatggcgaacggacggccatattacgcacagcaaaagcgacatttcaatccgttacaaagcagcgaggcggcgattaattgcgcaaaaagtgaataattttcatgcctgagatttggcatccatgaaatgcttcacacttttttaatatcagaatataaaactggttttcggttaaataaaagttacggactggataataatgctgaaatgatgaatcgggctgaaattttgcgtttttattcagcccgataataggtttagcggtgttttcttcccggcattcgcgggtcgtctttgtattctgcggtggcgatccaggcggcgcagaacagcgtcagacgggcgaagaagtagaagaacgccatgataccgagcaccgaaccaaaggccgcgccggacggcgactgcaccagtgaaggcagggtataggtcatgataattttaatcacttcaaagccaatggcggcaataagcgtcccgcgcatcagcgcccgcttacgcggtctgtggcgcggcagtcgccagaagatccagaagaacagcagatagttggcgcagatggaaatcgccagaccaatcagccgccaggccggtttcagccactcgatagaatccagatagagcgccgaaatgatcatctcctgcgctgcgccggaaatggacgtgatggaaagcgtaatgatcagcgccaccagcaggccaatcagcgagacaaaatcgcgcagatatttcacccagaacttttcatcgtcctgggcgttacgctcccagacgtcacgcgactgggcgcggatcgcttcgcgcaggttgcccatccagttaacaccggagtagagcgccacccccaaccccaccaggcctaccgttgtacgctgttgcacggcaatgttgatggtatttttcagcgtggaagccagcgtcggatcgctgacgttggtgaggatcttattaaaaatatcctgcagcagcgtcgggttcgacaccagcacaaagcccgctgccgcgaaggagaccatcagaatggggatcatcgacaggaacgaaaagtaggtgatagcagcaccaaactgattgcccatgcggtcattaaagcgttcggtggcgcggatcaggtgcgccaccatcgggcgtcgctggatcttttccgcggtctccttcaccgtttcgatggcaccgccgccctcaccttttttttcaggctccggttccggcttatccgtggtgtccattttttttaccggctcgtagtccaggtcctgagtcggtcgtttctcgctattttccgctgtcatcagagctgtgttccttcgttgttagcgtgatgtaacagaaattatagacggtcattggtcaacgtaagctttcatcacgtcagtcagccattccatgaacagatgcacccggcgcgacaggttgcggcgatgcggataaatcagcgataccggcatcggctgcgcgcgatactgcggcaggatttccaccagtttgcggctgcgcagcgcctcccgcacgccaatgcgcggcacctgaataatccccagccccgccaggcaggcggcatgataggtttcggtactgttgaccgtcaggatgccgccggttttgatccactgcgtggcattgtcgcgatatacctcaaagccctgcgggcgcgtaccgaggttaaccgcatagtgcaccaccgcatggccgctcagatcctccagggtttccgggtagccaaatcgcgcgaggtaatcggggctggcgcagttgatcaccgacagcttgcccagcggacgggcaatcaaccccgaatctttcagcgtgccgacgcgcaccacgcagtcgaagccttcgcggatcacatccaccagccggtcgctgctgctcagttcaatttcaaggccgggatactgctgtacaaaggtggacaggcgcggaatgaccaggttttttgccactgcgaccggcatatccacgcgcagtcgtccgctgagggtggaaggatcgtgcaaaaataaaccatcgagctcatcgaggttaataagtaaatccttagcccgttcgtaatagaccatgccgtcctgggtgagctgtacccgccgggtggtacgatgcagcaactgcgtgcccagatggttctccagcgcctgtatctggcgggagacgctgcctttcggcagacccagcgactccgccgcacgggtaaaactttccagttcggccacccgaatgaacagctgcattgcgtaaactttatccatcgccgcgccctattgttgttgtaaatgaaacagtgaagcgtaccgggacatctttattgattttctatcacctaataagctgcttctcaatcaccacaccccctgaaatgaggtttcttatgacacaacctatcgcaatagtgaccggcggcagccgtggcctcggtaaaaacgctgcgctgaagctggcggcaaagggaacagatttgatcctgacgtatcacagcaatgcgcaagcagccgcggcagtggtcggggaaattgagcgcgcgggcgcgaaggccgtggccttgcagctggatgtcagtgatgtcagccagttcgccggatttgctgaacaggtgcggcaactgctaaaagacgtctggcaacgtgacaacttcgactatttattaaacaacgccggcgtgggtctgtacgccccttacgcggataccagcgaagcgcagtttgatgagatgatgaatattcatctgaaagggccgtttttcctgacccagcgcctgctgccgctgatgaaggacggcggccgcatcctgaacgtctcctccgggctggcgcgctttgctctgccaggctccagcacttacgccgccatgaagggcgcgatggaagtgctgacccgttatcaggcgaaagagctgggcgcacgcggtatcaccgcaaacattattgcgccgggggcgattgaaacggactttggcggggggcgagtgcgggatgacgcgcagatgaaccggtttgtcgcctcgcaaaccgcgctgggtcgcgttggactaccggatgatattggcgacgccatcgccgcgctgctcagcgacgaacttcgctggatgaacgcgcagcgtattgaagtatcgggcggaatgtttttgtaagtgtcaaaacaaacgggggcagcgcccccgttcggttattctttttgcagacgtgaaacttttatccgcggcggggtttgctgcttgtccagcgaaccggaaatactgatcagctgatccgggctgacttctctttctgtaaataccgccatgggaatataagcgtctatctggccggttttatcgcggaaggtataaatatcgttaccttttttcgcgatcaggttaccgcgcagggtcacagaggcatcgtcgtgcatctctgtaacatggtcgacggtcattgagtgggcttcttcagcgccgcggtagccgtcattgagcttgtgcgccggtcgcggcgcttcatccgtattcaggccgggcttatcgtcggcaagcgccggaagggcaaataacgccgctaccgtggcggctacaatcatttttctcatgctgactccttaaattttgcctcgctatcctgttaagcctggcataaggatcagcattatgaagggcgaatcgtctggatcagcggtattcatggcgcagcaaaccgaaaagccagtcattttgccactgcccgttcagccagaacgcttcgcgcagttcaccttccagtatgaaccccgttttatccagtaatccctttgatggcgtattcccggcagtgaccgtggcgataagccgacgaatgccgccctgctgaaaagcgtagtcgcacactgcccgcagggattcgccgccaaagcctttgccctgcgcctgcggcacaaacaggaagcccacttcagcgcagtccgcttcatggtgcacataaccggtaacgcccagcggctgccccgtggcgcgctcaaataccatcagacagagccagtgcgcgctgcccggcgtccatggcggcaggcggctctcgaatgccgcgtggatctcctcctgcggacgcgggtcagagacaaaacgcatgatctgcgcatcctcatacagcgcgaggaaaaacggccagtccgttgactggatctgtcggcaccagaggcgttccgtggtcagctcaagcatatttcgcttccatatctgtgcagccgtcactgatattcctgtataactggtctatcgtataagtggctggaaaaaaagaaaaaataaagaaaaatgcccacaaaattaacgtcggctggttgcacttaaaggaaaataaagatgcgcaattcaacgtctggcattcgcgaacagtttgaacactgtatcggcatcattcgtcaggcctccaccgaaattttatcactgcttgatattgatgtgaccgagggcaaagatccacgctggtttctggaacagctggacgccgcccgggcgaatcttggcggctgggcggcggtcgctcaccggctgcggctgaacgatgcggaactgtcgcagttcaccctgttgttgcgccatctgcaacagcgggtgccgcagtatgaaagcgggcaggaggtcagtgaaaaccagctgatcacggcgctgcgctttatgacctcccttgaactgctgcgggaaaaacagccgcagctcacctacagcaccgaaatcactgtgctggatgagacgcagcaacagcagcaggcgctggcgcagttacgggcgattgagctgatgatcaaagcgctgatctacgaagcctggcccgacagtatccagctcagtaaccatctgaaaacgcagttcggcgtcgatcgcgtgcggcgctggctgaagctgggcgagcgtaacgacgtgttaagcggcatgttattcagcgagctggcgctgatgctggtggataaaaaagagttcacccagcgctactcggcactgtttaacgatccgcatacgctgatgctgtttgccgagccgcgcaaaacgctccaggtctttctggatgacatccggcagatccgcaataccctgatctcccaggatttgctctccccggcgcagctgcgtttactggacagctactacccgcagatcaccagttccgtgcagaacgccttcagagaagggcgcacccgtatcagcccggatctgttactggcggcagacgcggttgagctgcaatctttctgggagcgggcgcgtaaaaaagcgcgcgctaccggcggtgatatttttgaggttcgtgacagtattgaacgaccagggcagcgcgcgccacgcaccccggagcagcgggaacaactggtatcgggggtgctgtggggcgcggtaggcgtgatggtgctcggcatcatgggcagcgggctgtggttgttcagcggtggcggcaatcccccacaaactgcgcaggccgcccagacagaagtgcagcaggagcagagcgagccgctacgcgaaaaaccctcgtcgcgggagaatctgacccgtatgggcattacctgggacgaaaataatctgcgtgcggccattaaccgtaacgattcgcgggtggtgcagctgttcttgcagggtggtatggactggaagctgtcgtggacggaagaggcgatgtcagcaggtcacgatgatgtactggaactgctgctgcgctatcgcctgcaaatggtggaactgaaaccctgccgacgctttatcagcaccctgagccatgccatggtcaccggcgaaaagctcacctcaatgcgcaaagcttatctgcgggcattctgtacgacgcctgcggtggtgaagcgtcagcaatatgaaatggatcaggcgaagcgcagagctctcgcagagccggacgcccgcaccaaaaaatggctggcgatccagacatcgatttatgaggtgattgactaaccgctgtatgcccggcagcgcgtcgctgccgggtagcgatcagggttcgccgtacagaccaatcagacgccgtaccacgccgttcgtccagccaaagccgtcctgcaacggatattcaccgccgcccccttcgcgcggggtaccgcctgcgatgtggtacttctcaatcagcttatggtgacgctggtaaaacagatttaccgtttccagccagctgtgggcgatctcatctccgagcgcatcattaccgtagagtttaaagccctggatcgccatccattgcagcggagcccagccgttcggtttgtcccactgctcgccggtttcatattcagtcgccatcacgccgcctggcgtcagcagacgttcacgcaccgctacggccagccggtcggcctgttcatgcgttgccataccgacatagagcggaacaagactggcggcggaaaacagcgccatttcgccgcgtcgccagtcgtaatcgcggtaacagcctttctcgtcgtcccacagatagcggttgaccgccgcacggcgatcgctcgcccgctggcggaacatcgcttcgccttcccggtcgcctttcacgccggaaatattggcaatggtgctttccagtttgaacaggaaagcgttcaaatcgatagggataaattgtgtggtgcggatactggcgaggcggttcgcatcgcgcagccagcgggaagaataatcccagccggacgccgcgcccgcgcgcagatcgcggtacacttcgctggccggacgcccggaatgacgggcagtttccacgtcctccagccaggattcatcgcgcggcgtatcacggtcatcccagtaacggttgagcagcgatccgtccggcatacgcaccgcagaacggtacgcctggtttggcaccagcgattccgcgccgtccatccagaagctgtactccatcagcagatgttccagatagcgacgcgcgccgcgcacgccgtcttcctcaaacagttccaccatcagcgcaaagaccggcggctgggaacggctgaggtagtaagtccggttaccgttcgggatatgaccgtaacgttcgatcatccacgcaaaattgtccgccatgcatttcagcaggtcgttacgcccactctcggcgaggccgagcatggtgaaataggagtcccagtaataggtttcgctaaagcggccgcccggcacgatataggcctgcggcagcgccagcagcgatgaccacgggatatgatcctgcggctcgcgggtcagtatcggccagagctggtcgatgtgttctttcagcgagtttttgggatcggagacgtattcgctgccgtactgttccggcaaccagaaatgcgccatgacgaacttttgcagatcaaaatcagggcggcgtttgatacggcgataacggatcagaatatcaaggggatccattttcggcgcacagtcgggaaaagttttgctgtcggcaaacagtcgggtggactgcacgtgttcaaacagttccagatagcgatcggcaggcgtcagcgcatcggaggcggggtagccttcgatcatttccggttccggttccgcctcaagcatttccgcaagcttgagctcgtacggatcggtgtcaaagctggttttttcttcgatcacgaattcaacggattcatctggtttgagtttctggttgaacatagtgatgctgacctccggatggcgtcgtaaaaagatacgggtgttgcccggctacttataagcgtagacagtctttttacccgttgagttgcatactgtgcggtagatcacatttcttcacgcctcgtctggcgcgggaaaataataaatcgctgtttgcactactgatttcccgaatgcacgaacggcgactgcccccacaattcagagcaatcgctttgcaacacgatatgaatgttttccggcaattagccgatgacatgccccactttaacaaacagaacaatcagcgccgtcgccagcacgacgatccatggcgtataacgaataaacgggcgcaaaggcttattttgtccttccgccagacgtcgcagggtggcagagagcatgccatgcagaccggagagcaccaccagcacgacaattttaaggatcagccagaggggcaagccgccgccatgactgacaatcatcgccagcccgcaggcccagaggatcagcatcgcaggagacgtcacgctgcggctccagcggcgaacctgggcgagcagcgaaatatagttgctggtattgcccgcgccacaggccacgaccaccaccgccatcatcaataaaccgccgagccagaccatccctgtaatcagatgaatgacgtttaaccactggtgagccatgtttaatccttagaaaataagcgtgcgtgcggataagcgtactctctaaatggattaaagttgagtatgttcttataaaaaaaaccggcacgatggccggtcttcagggggcggtgttaaacgtccgttacagcgtctgtaaaaaggccagcagatcggcattcagctcgtcggtatgggtgacggcaaaaccgtgcggcgcgttgtcgtaaaccttcagtttagcgccgacgatcatttccgccgccactttaccggtgctttcaaacggtaccacctggtcattgctgccgtggatcaccagcgtcggcacgtcaattttcgccatatccgggcggaagtcggtttctgagaaagcggttacgcagtcaatggtgcctttcagcgaggccagcagcgcaatgttcagcgtctgggtcagtacgccttcggagacggtctgcccggcattggtgccatagaacggcgtggcgaaatcgctgatgaactgcgcgcgatccttacgcagcccctgacggatgccttcgaagacagacatatcgacgcccgccggataatccgcggttttaccgaagatcggggtcactgcgcccagcagcaccagacccgccacgcgcgaggtgccgtagttgttgatgtagcgcgtcacgtcgccgccgcccatggagaagcccaccagcgtcacctgttgcagatccagatgggtgatcagatcgttaatgtctgacgcgaaggtgtcgtagttgtagccattccacggctgatcggagcggccaaagccacgacggtcaaaggcgataacccggtagccgttctcggcgaggaaattgagctggctgtcccacatatcgccatccagcggccagccgtggctgaacagtaccggcttacccgtgccccagtctttgaaatagatctgcgtaccatcctgcgtcttaaatgtgctcatgctttacctcgttgattaatatgcatttaacaagtcgagccttattctggcgcgataagataacgaacttccggaagatcggacccctgatggaatcctagcacccgattctgaattttcttgtcgttcatggtgtagcgctcccgctgacgcaaatgctccatccaggatccgacgacaaaggtttccacgaaaatacccggttgcaggatgtcttcgtaaatcgcccagttcagcgcgccgccgcgtcgcctgacgcgacgcatatcctgcatacacaccacaaaatcatgggcgctttgcgggctgaccaggtagtgatagctcaccatgaccgggccgcgatcgtggcggatctcaagctccggcgcggcttcgttaatggcgctcagatcgagattcagatccggatcctgatccagccgccagcgcagcacggtggcgctggccagcaacatgcccgccgtcgccacacagagggaaaacggaatgctgaactgcgaggcgagctggccccagagggcgctgcctgcggtcatcgaaccgaagaacaccgtcaggtagaccgccagcgcgcgggctttcacccatttggcggcgctgcgttgcgcccccagattgagcgtcgacagcacggcaatccacgcgaagccggtaaagaattcaaaggcgttcagcagccagaagtggcggacaaaggccagcgccagcatcgtcacggcaaacatcacgctcgccagcaccatcaattggtccgggttgaagcgtttgcgcatgcgtggcagcagcagcgcgccgcataccgcgcccacgccgatgcagccaagcataatgccgtaaccgcccggccccagccccagttcccgacgcgccaccagcggcagtaatgcccagcccgcgctgccgaaaacaaagaaggcgacggtgcgcactaatacgttacgcagcaccggcgcggcatgcacatagcgcacccccgcccgtaccgccgggaagaagtgctccggcggcagacgctgcacattcggctgcgccttccacacatacagtacccagaagacgccgagcaccgacagggcgttcagcaggaacaccatccacggccccgcaaaggagagcaccaggccgccgagcgccgggccgatggcgcggctgatattgatccccagcgaattgagcgcaatggccgatcccagctcttcttttttcaccagatccggcactatggcctggaacggcggcgagctcatggccgcgccggtgctgagcaggaaggcggcgatcagcaggacgcccggcgtgaccatatccgcccatgacataaacgtcaggcctgcggcggcgataaacacccagatttgcgagaacagcaggtatttacgccgatcgacgatatccgccatcacccctgagggcagcgcaaagaggaacatcggcaggctactggcggcctgcaccatggcgacggagagcggatcggcgctcagcgtcagcatggtccagttgatgccgacatcgttcatccatgagccgacattcgacaccacggtggcgatccacagcatgcggaacacacgctggcgcagcggctgccacggggaaaccgccgccgtgaccggcggcagatccgctttaggcatatcgtggatgtcattaacctgcgccacgggacacctccgtaatgccgcctgacgccatgcgccagcggccagggccggtcagcgccagggtgccgaagatgatcagcagcagccagccgaactgcccttcggcaattgaccagtcggcatgtaccaccagcatcgccaccagcagcacgccaataatcggcaggcaggcgaggcgggtaaacacaccggcaatgataaacagcgggcagatcacctcggcaataatcgccgggatcaggctcatgtacggccccatgccgaaaggatcttcaatacgtgtcagctcctcgctgaagtgaaaaatcttcggtaagccatggacatacaacagtagcaggctgcccgccagacgcaggaacaatagccccatatcaatacggggcggattaacgttcagtgaatttttcatggcatcagaacgcaaagcagctgcaaccgagcgcgccccagaaggcgttattttcggcaaccggtacgtttgaaccccgcgcaatatcatgggagtgactatgtacgccgcacggcccgctgcactggtgcggcatctgctgcattccgacgcgggtttgggcgttcggcggcgcgctgcggtagtggccagggacgttcaccaccggcgaccattccggcagaaccgggatagacggcggcgcttctgcactgaaggatccggcggcatagacaatattgccatcaacaatggtcagcacggattcaatgcctttgatctcttcttccggtacggcgaaatagtctttgctcagcaccaccatatccgccagctgccccactttgatctggccttttttgccctgctcgctggagaaccaggcgctgccctgcgtccagagcatcagcgccgtttcacgatcgagacgggcgttaacgtcatacatctgcatgccgccgacggtacggccggaaaccagccagtagagcgcggtccacgggttatagctggcaacgcgggtggcgtcggtacccagaccgaccggcacgccggtttccagcatacgggcgaccggcggggtgtggcgggtggcttcgatgccgtagcgctcggcaaagtattcgccctggaacgccatgcggtgctgcacggcgatgccgccgcccagttctttaatacggtcgatattacgctgggtcacggtttccgcgtggtcaaagaaccagtgcaggccgttgaacggaatgtcgcggttcactttctcaaacacgtccagcatacggctgatggactcatcgtaagtggcgtgcaggcggaacggccagcgatgctccaccagatggcgcaccacgcgctccagctcatcttccatgcccggcgccagatccggacgcggctcgaggaaatcttcaaagtcggcggcagagaagaccagcatttcacccgccccgttatgacggaaatagtcgctgccctggcccggcgtcagcatgtcggtccatttttcgaagtcttccagctcatgtccgggacgctgggtaaagaggttgtaggcgatacgaatggtcatctgcttcttctcatgcagctcggcgatgacttcgtaatcttccgggtagttctggaaaccgccgcccgcgtcaatggcgctggtcaggccgaggcgattcagctcgcgcataaactggcgggtggagttcacctgctgctccagcggcagtttcggccctttcgccagggtggcgtagagcatcatggcgttcggacgggcaatcagcatcccggtcgggttgccgttgctgtcgcgctggatctcgccgcccggcgggttcggggtatctttggtgtaacccaccactttcagcgcggcgcggttgagcagggcgcgatcgtaaaggtgcagcacaaacaccggtgtgtccggcgcggcctcgttgatttcatccagcgtcggcatacggcgctcggcgaactggaattcgctccagccgcccaccacgcgcacccactgcgggtttggcgtgcgcagcgcctgctctttcagcatgcgcagcgcgtctgccaccgacggcacgccttcccagcgcagttcgaggttgtagttcaggccgccgcggatcaggtgcaggtgcgaatcgttaaggcccggaatggcggtgtgacctttcaggtcgatcactttggtggcctcgcagtgatactgcatcacctcattaagcgtaccggcttcaataaacttgccatcgcgaatggcgaccgcttccgccagcggattctcgcgatcgacagtatgaaacttaccattcgtcagaatgatgtcggctttaccgagggtaaccatagaacctccagaatgaagatgtccgtaaaaaaggtatgtgaaccgtggacaataaaatgcctgagcagtagcgcagggggagaatggcgggattatggtcaggcgggataaaaagcgtctagttatacgaaggtatagttatacgcagagacaataggcgggaaatcaaaaggttcttacactgcgccccgacagagacacttaacaattaacctcaatgggcgacatcatgaacaacagcaaacttgaattactgaccccgcataactgccagatgatctttatcgaccaccagccgcagatggcatttggtgtgcagtccatagatcgtcaggtactgaagaacaacaccgtggcgctggcaaaagcggcgaaagtgttcaacattcccaccatcatcaccactgtggaaacagaaagcttctccgggaacacttatccggaactgctggatgtcttcccgggtcaggacatccttgagcgtacttccatgaactcctgggatgaccagaaagtgcgtgacgcgctggcgaaaaacggcaagaaaaaagtggtggtagcaggtctgtggaccgaagtgtgcaacaacagcttctctctgtgcgccattctggaaggcgattacgaaatttatatggtatcggatgcctctggcggtacctccaaagaagcccacgacatggcgatgcagcgcatgatccaggtgggcgtgatcccggtaacctggcagcaagtgatgctggaatggcagcgtgactgggcgcgtaaagagacttacaccccggtgatggatattgtgcgtgagcactccggcgcttacggcatgggcgtggattacgcctacaccatggtgcacaaagcgccgtcacgtcaggaaagcgagcaccgcaccctggcgccggtaccggctccggttcgctaatcactgccgctggccgtcaccgggtgtggcggccagcgcctttttacaaggaggacctgtgagtcctttactaatttctctggcggcgggtctgcttatcgggctgatttacgcgctgctgaacgtccgatcccccgcgccgcccgcggtggcgctggtgggcttgctggggatgatcctcggcggtcaactggccgcgccctttatgcatcctgagcctgtcgcccgtacttccgatgcaaaacctgccgcttcttcccactcctcctccgtaacgtccagcgctaaacaggcgggttaaccatgctgaaaacctatattgtttctctgttaatgggtattctcgccggggtgatttataccctgatcgaagtgaattcgcccgccccgccagtgatcgcactgcttgggctgtttggcatgctggttggcgagcaggtcattccgttatgcaaaagattaatcagccgccagccggtgactctggcctggttccgtcatgagtgcgtccctaaaataagtggtacgccaccgccttcgggtgagaaacgcccttagaaaggcctctcaacctgttgtgagcctgtctaaggatatcagcatgaagctgtcgaagtgcattgtagtcgttgatgatgaacgttccgttcgcacggggctgagtaatttacttgagtctgatggctacagtacgcaggtatttgagtcggcagaagcgctgttaaatgatgacgccgccatccgggatgcggcgttgtttattattgatgttgaactgaaaggcatgtccggctttgaactcttcaaagcgctgggcgaacggctggaaaaaccgccgggcattattatctccggtaacggcgatgacaatatgatgtggtgcgcgatgaccctcggggcgattgcgtttttacccaagccgatcaacattgatacactttttgaacatattcatcagacgttttctcaccatgaggagggcgaatgagcagtatgcttctgctttaccaggcggccgaaatcgacagtttcctggtgtcagatgaaatgacccttactccgctcgccctggaagggaacgttgaatggctggtgtgtcgcgataacgcgacgggcgaggcctttacgctggcgatgcccgcctgcgaggaagcgggttatcagatcacccgccgcctgaaaaacgaatatgccctgcgcgacaccttgtctgaacgctgggcgctgaaaccgctcggctatacccagtttcagggacgttacgcgctgatgtatccggcgttcagctggcgcaccctttccgacaccctctgtctgcccaccggttcgctggttgatttccttcggcaggcgatcctgctgacgtccaccctcagccagatgcatcaaagtggtctggtgcacggcgacatcaaacccgccaatttcttcattatggatgaggagcgttatctgctcggcggttttggtctgactaccgacgcccaggcgcagcagtcccggctgccggtgacaggcggcaccctggcctatatgtcgccggagcatacctcacgcaccgccgatccggtgagcagcctgagtgacttatacagcctcggcatcgtactttatgaactgctgaccgggcgtttaccctacggcaatctcgacggcggccaggcggagtgggtgcatcatcacatcgcctccgaacccctgccgccgcaccggttgcgcaaggacgtgcccgtggtgctgtcggccatcattatgcgtttgttagccaagtctccggacacccgttatcagacggcggaaggactgctggcggatctctatcgctgccagtcgaatctgatgccggacgggctgctcagttcgttctcgctggggcagcaggatacgcgccgcagcgggttgacgtcggatgcgctctgctctgaacatccgcaggcggcggatattctttccgcttatgacgaagtgcacagcagcggcaaacacgcgctggtggtgatcgccgggccgccgggatcgggtaagtcctcgctgatggcttcagcactgaagatcctgcaacagaaacagacgctgctcaccgttgtgaaggcagatcagcactccccggttttaccctacgccattttcaccgccgcattcagaaccatcgcgctgcatctgcttggcctgcccgccatggagatgcagcgctggaaaacgcatattcagcgactgctgggcgattacgcggggctggcgattagcattattcctgagctcggcgtattgctcgggcaaaaggcggccttgcttaccgatgtgcactcgctggatgagcgggacaaattcaactgcatggcctgcaacctggtgaaagcctttgcgacgccgggcagaccgctggtcatgctgatcgacgacgtacactgggcggatcaggcgaccttccaggttttacagaatctgttaagccttagcgatgatattccgctgctactggtgctgtcgcaccgggacgaagcctcgatgccctgtccgattgccagcgccaatctggcgcgcattcgcgcggcggcctcgcgcattatcgacatcacgccggagccgctgtcggtcaaaaatattgcccgtctgctggcggggcagttccatgccagaaccgccgaaaccaccgagctggcggcgctcctgcatgagaaaaccggcggcaacccgcagttcacccatgaactgttccgtcaggcggtgaaggacgggctaatcagctggcagaaaccgatgaagtggacctgggatcgccatgcgattatggcatttcattattccgataatgtcgcctcgggcatcgtcgccaggctggaaaacttaccggtgcacgcccggcagttgctgggacggctcgcctgtatcggcggcgcgggcgacaccatgctggccgcgcacatccttgacctgtcggtagccgaactggtcgcccgtctgacgccagccgccacggcgcgattcatttccctgaccgataaaaaatacgcctttatgcacaccagcgtgctggaagcggctgccgggctgatcccggcggatgaaaaagacagcctgcacctcttcgcggccagcgcgctggcagaaatggcgggcaatgccatctccagtgagccgctgttcagggcggtgcatcacatcggggcgatcaagaattatgccctgctgcgccctgacgccgaccccttcgcggcgctgatcctgaaagcggtgaaacgcgccaaagtcaccggcgattacgcctcggcgctgcgttttctgcacaccgcccaccatctgaatgcgctggtcagcggcgacacccgcgccatgtttatgctggaggaagccgaatgcgaattcctcaacggtaacctctgtgcggcccgtgaactatgcgccacgctgctcggcgcgccgggcgatctggcggataaagccatcgccgcctgtctgatggcggagatccatatgcgtcagtcggacagccagctggcgctggaaacggcaatcgcctggctggcggtgttcggcatcaagttgaacctccatcctgacaaacaggagtgcgatacggcgcgtcaggccctgaaagcggatgtgggcaaaaacccctacagccgtttcagaaacctgacaaaagtgacctgccgcgaaaccgaagcggtaatgaatttaatggccagcgccagcacctatgcggcctttatcagcccgcgtttgcagttcatgatcctctgcaaactactgcatctgacgctggcccgcggtatcagcggcgcctcgaccttcgcgctctcctggtatggcgtgctgtgtggcgatcattacgatgagtacagccggggatttgccagcacgctgctggcccgccagctggtgtataagcacgattttgccagctataaagcgcgcacgctgctgccacttgaccaggtgagcatctggacgatgccggtgacttacgccattgagcaggcaaaagcgaccttcgacgtggcggtggaagttggcgatcgcaccaccgcctgcctcgcgttgcgccatgtggtgatgaactatctggcgcgcggcgatcacctggacggcgtgctgacctctatcgagcgcggcctgagctacgtgcgcaaggcgcaatatcgcgacgtcgaagtgatcctgctgatgcagcgtgattacgttcagttcctgcgtcagccttgcagcgaaggattttccggtcatcgcttcacgccgccggagctgcacgttgtgcagtcgggtagcgccgtggagcccatcttcctgatgcagttctggtccgggttgtataaaggcaaagcgcacttcttagccggtgaatatgattgcgcgagccgctgctttgcggagattgccgctctgactgggctgatccccgggcatacccatatgctcgatttccatctctacagcgctttaaccctgtcggtgcccctgtcgccgacagcggtgacggatgacgtgctggaaaaatttaaccgacatctggacaaaatcaccacctggtgcgccgagaatacgaaaaccttctccgataaagcggcgctgttgcaggcggagctgctgcggctgaaaggcgacgcgaccggcgcggccgaaaaatatgagtccgcgctggcgctggcgcgcgacggacagttccatcacattcaggcgctggcctgtgaactggccgcccgccttgccaccaccaccggcatgcgctttgccgcggaagcctacataaaaggcgcaatcagcgcgtgggaacgctggggcgcgggcgctaaagtacgtcagctggagagccgctatccacatctcaccacccagggcacgtagacagcgctggatacgctcgctttcgagcagaacgccgagataagcgacctccagagtatggtgaccgcgatccgcgccctgacggaggagatcaatcttaaccgcctgatcaacacgctgatgatgatgctggtggaacgggccggggcgcagcactgtctgctgatccgtctgatcgacggcaatattcccgagatccaggcgcgggcgaccactaccgccgaaggcatcaaagtcaacattgtgaaagaaacaccgctggccaccgatttgccgctctccgtactggcggcggtgatccgcaccgggcaggagatccgcaccggcaaaccggaaacgttcagcccgttcagtcaggaccattatctggtggcctcgggtgcggcggtgatgtgcgtaccgatgtttaaacaggcgcaaatggttggcgtgctgtatctggaaaaccgtctgctgccggatgtgttcaccgccgagcattcgcggatcgtctctatgctgggcgcgcaggcggcggtatcgctggaaacggcgcgactgtacgctgaactgctggatgaaaacatccagcgccgcaaagtggaaaaacagctgcgcgccagtcagaagtcgctgatgttaggggaaaaaatcagtcacaccggtacctggcactggcacctggaacaggacatcatgctgctgtcggaggagtacacgcgtatcgtcggcctgccggatcatcagggcagcttgtcgatggccgattttatgacccgcgtacacccggatgatttcagcgtcatcaacgatctggtgaccatgagcgtgcgcaatggtcagccgatgcaggcagagtttcgcatcatcaggccggacggcgtgtgccgctacatcaagggcatcggcgagccggtggaaaactggccggaagtgaaagagtatttcggcaccatcactgacattaccgcgcagcgtaactccgaagacgcggtgcgcattgcccaggccgatctggcgcgcgtggcgcgggccaccacggtagggcagctgacggcgtccatcgcgcatgagatcaaccagccgctgatgtccatcgtcgccaatgcgggcgcggccctgcgctggctgaaacgcgacccgcagcacctggaaaacgcctgtaaaagtattaatgaggtgatcagcgaaggaaaccgcgccggggatattattcgcggcttacaggcgctgacccgcaaccaggaagcggaatttgcccaggcccggctgcatggcctggcgcgtaatattcactccctgtcacggctggagatggagcggcgtttcatctcgctggagctggatttccgggcgaccaatgaccgcattttctgcgtcagcgtgcagatccagcaggtgttgctcaatctggtgatcaatgcgatggatgcgatggcggacaacatgggcgtgcgcagcctgcggctgtcgtcttcccagccggatcctgcgaccattcagtttgacgtcgcggataacggcagcggcctgacggaggcgcttatcgaaaagatttttgattcgttctttaccaccaaagccgaaggtatggggatggggctgaccatcagcgccgagatcatcaagcggcacggcggcaagctgaaagccgccagccgggagagcggcggcagcattttctctttcacgctgcctgtgcagccggaagagagcgtctgatcaccctcagctgtgtttattatcgaggttaagtttttcggtggctttgaccagatcggaaagggtgcgcaccttcatcttttccatcacgcggcgtttatggactttggcggtgatttcgctgatgcccatctgcgccgcaatttgtttgttgagtaatccggtcaccaccagctgcatcacttcgttttcgcgctgcgtcagggtgcgggcgcgcgccatcagttcacgtcgttcttctgcgacggccatctccgcttcagaaaaggccagcgcatccgccaccgccagcagcagcggatcgggcaacacgggcttggtcagaaactcgtaagcgcctgctttcatggcctgtacggtaaccggaatggtgccgtaaccggtcaggaaaatagccggaatggcgtagcccagctcgcgcagattgcgcgtcacctcaagcccgttcatatcaggcatattcaaatcgacaatcaggcagcagggggcagggtagtgcgaatgggacaaaaacgcctgcggtgaggtaaaggctgaaacggtataaccttccgcgctgagaagattgcttaacgatgagatgaccgcttgttcatcatcaaccacataaacggtgcgttccagagaagaagtcgtcataggctttgccggattttgctaacagaatgttaatatacctgtttagccgattgtttctatcaaaacctgccctgttaaccggtttagcacgctgaaagctgtaatttaatacaatgcaacacattgatattgctgctccctcagactgacaggctgtctatacttagaccgcgatatactgactggaggtaaaatggaatatctgtcccgattaaatattgtcaatatactgttatcgaccaccttctggatcaatgtggcgattgtcgttgtcgttaccctgatcacttattacttaatcaggcgattaatttcatttgcttataagacaatcgagaactggaataacaaacatactgatggcggtaatctgcggtatatcctttttgatatgctgagaaagaccaaccggttattaatcctgttcgcgtcgttcctgttcagcctgcgttttaccgcgctgccggatcgcttattttccaccatttcccacgcctggtttctggttcttgccttgcaggtagcgatctggctcgatcagggcgtgcagtcctggatgcatcgtttactccatgcgccgggatcaaaccgtaacccggtcaccatggttattctgggcatgatattacgggtgctggtctggtcgatgatgttgctgtcgatcctcgccaatgcgggcgtcgatatcaccgcgctggtggccagtcttggggtgggcggtattgccattgcgctggcggtacagacggtgctcagcgatgtttttgcgtcactgtccatcggcttcgacaagccctttgaaatcggcgatttcattgttttcaacgacgttgccggtaccattgagcatattggcttaaaaaccacccgtattcgtagcctcagcggcgagcagatcgtctgcgccaacgccatcctgttgcagcagaccatccacaactacaagcgaatgcagacccgccgcattgtgttcaactttggggtggccagttcaacgccgcccgaaaagctgcgtatcatcggcaaaatggtccaggacattattgaggatgtgggcgaaaccaagtttgaccgtgcgcattttctggcatttacccaggatcgcctgaattttgaagtggtgcatattgttaataccgccgactacaataagtatatggatattcagcaggagattaatatccgtattctggaaggcttaatcgcaaatgatattgaactggcgctgccgaacatggtggtcaggacgccggataatggcgcgcaatcgaccgttaatatgccagtgacggtaccgcagcaaagtaattaatcccaccaatattggtaggcccgcgtaaattagcgggtctgccagcgatgaaattcgtattttcttactaagataattctcataatcctgttatatgaacattcattaagttcgtacgtgattttttacggtaaattcatgtaaaaattttgtgcagaaataatgcaacatatttcacaaccaaggatgttcattttatgaccacgttaaagcctgccttattactttcggtgtgtattttaaccgcctgtggcggcggtggtggtggcggtggtggtggtggcgataaaacgccgccgaccacgacgccgccggtgcagacagacaatggttctggcagtaacgctggcaataacaataccggcaccacgccgcaaccgcctgccagcgcgccgacaagcctggccaccgggggcaccctgtcaggctatacctacaccacgccgcagggcctttcctataccatgcgcggtaccggtatcgaaccggcctatgtctttacccagtcgctgaccagtacggacggcacccgtcattccgccacctcctggtgctgcggccgtatgagttacaccacctttggcacctggaccgactttaaaacgggtaagcatgacgtgttctacacgggcgagccgacgctggccgccaacgtgcccacgcagggtacagcgacctatgtcggtaacggcatgcgtgaagacattcgcagcgatgccacttttaacgtcgactttgccgcgaaaaccatcaacggcaacattgccgcaggcgacgccttcggcagcgctgtggcgatgcagggcaccattgcggacggcggtttcaccggtaaggcgcagtcaggcggtcaggacggtaccttcaccggccacttcaacggccctgccgcgcaggagctgggcggtcttgccagcttcgccgacaccagcaaaaacgtcgcttttggcgcaacgcgtcagtaactcgcctcccggccagcccgtctggccggtttttcatgatggtataaatccctatgaatgtcctgcgtacaggcgcaataagcctgttgtttccgctcggcgccgccttagccgcgccgccggatactgacgtcattcccgctgcaccccattttgatcgtctgacacagcaggataaaagcacctccgccgccggaacctttatctctgttaacaatgcgcaacttgctgaacagcctgagctggcgacggcgctgctcgatcaggccgtgcgcgaaggcaaatggccgatggtggaagccattctgccggtgtatgaagcgtcagccagcgccgatcccacgctgatccgcttcgcaaaggcggggctggcccgcagcaagggcgattacgatcaggctatcgcgcactaccgcgccattctgagtgaacatcctgaacttgatgcggtgcggctcgacatggcccgcgccatgtttgaaaaccaccagtacgatacggcggaataccagtttcgccgcgtgctgcaaagcaatccgccggaaaatatccaggcgatcattggcgtttatattgaacgtattcaacagggcagcgatctgaccggcagactcagcgtcagctatcttaacgacagcaatgtgaataacgcctcgacaagtaaaaccattcgcatcggcgatcggctctttttacgcaataaagaaagtttcccgcagcggggagagggcttctggtttaacggcgcactacaaaaggatgtctctttgtataaccagcatggcctgcgctttatgggcacagtgaacggcaaaagctactggaataatcatgatttcgatgatattaccagccgcctttatgctggttatcagtggcgggattaccgccagcagttcgccctgctgcctttttatgaaaaaagatggtacggcacggaagcctattcttccggccccggcgtgcgggcggaatacagctacctgctttctcccgcatggcagataagtcaggcgctggaatatcaaaaactccattacgatgccgacgaatacggctttttgcgcggctatagccgttattcttcaaccacgctgtctcatgctttcagtaatctggtgtcagcctatgcgggcgtcgatattcaggatcagcaaaccgcggcaaaaagtgaaactaatcagcggacaggcgtgcgcggcggggtacaggtggacttaccctggcagatttcgttttcggcctccacggccttcgcaaaacgtcattaccaggccgacagtgaaatattctccacccgccgcaaagacaatgagcagtattataatttgtcgctctggcaccgggatctctatgtatttggcgtgatgccgaagctgaatttcagctataaacgcgtcgacagtaatatcaatttttacgattaccatcagcgcaatatcacattgtcgctggataaaaacttttagcggcgtaatggcgaaaaaaaactggcgataactcgccagtttttttattgctgaaatagcaggaagggcattaccgcatggtgacaaattcttcggcggcggtcgggtggatcgccacggtattgtcgaaatctttcttggtcgcgcccattttcagcgccacggcgaagccctgtaaaatctcgtccatgccgaagccaatgccgtgaatgccgacgattttctcgtcttcgcccacgcacaccagcttcatgcggcacggctgacggtgggacgttaccgcggtatacatcgccgtaaaggacgatttatacactttcaccgcctcgtcgccgtactgctcgcgcgcctgcggttcggtgaggcccacggtgccgatcggcggatggctgaacaccacggtcgggatattgttgtaatccagatgctcatccggcttgttgttaaacaggcgctcggacaggcgacgacccgccgcgaccgccaccggcgtcagttcaacggcaccggtgttgtcgcccacggcataaatccccggcacactggtattctggaacttatccacgacgatgtagcctttttcgtcggttttcacgcccgttaccgcgaggttgaaattgtcgttggccggtacgcggccaatcgcccagatcaggcaatcgacggttacactgcggccatcttccagcgtcagcagcaggctgccatcggcatttttcaccaccgacttcggcaccgcgtgggtgtgaagcgtcgggccgtcggccgccatcgcttccaccagcgtttcgctcagcatgggatcaaaactgcgcagcggcgcgtgtttacgcacgaacaggtgcgtctgcgcgccaaggccgttgatgacgccagccagttcaaccgcgatgtaccctgcgcccaccaccgccacgcgctgcggcatggccggtaattcgaagaaaccatcggagtcgataccgtattccgcacccggaatatccggatggctcggacgcccgccggtggcgatcagaatatggtcagcggtgatggtttcgccgttcacctcaacggtgtgggcgtccacaaaacgcgcgaagccgcggatcacatcgacgtgatttttacccaacacgttgtcataggagttatggatgcgatcgatataagcggtacggctggcgaccagtttattccagtcgaagtgattgatggtggtatcaaagccatagtccggaccataaagctcgattgcctcgcggatctgcgccgcatgccacatcacttttttcggcacgcaaccgacgttaacgcaggtgccgcccagcgctttggcttcaatcagcgcacatttctggccgtacatggccgctctgttgatcgaggcgatgccgccgctgccgccgccaatggcgagataatcataatgcttagtcatgaccgttccttaatagagtcgcatttgagcgcagtgtaacgcgcggcttaaaaggttccaccgatggttgcgattactccggcaccacccagttcaccagcgtatgccccgtaccggctggcaccagtttgctgtgcagccatggcagcacgttttgcatctgttgctccagcttccacggcgggttaatcacaatcatgccggaggcggtcatgccgcgctgatcgctgtccgggcgcaccgccagctcgatttgcagaatgcggcgaatgccggtggcttccagctctttcaacatacgtttgatttgcgcgcgcatcaccaccggataccacagggcgtaagtgccggtcgcaaaacgtttgtagccttcgctgatgccctgcaccaccgcctgataatcggtttttatttcgtacggcggatcgatgaggatcaggccacggcgggacggcggcggcagtttcgatttcagctgttgatagccgtcgccacgcgccacggtggcacgggcatctttctgaaattccgaacgcagcagcgggtagtcgctcgggtgcagctcggttaattgcagcgtgtcctgctcgcgcagcagctggcgggcaatcagcggggagccggggtaataacgcagcgtgccgctacggttaaaatggttcagcacggtgatgtagggcgtcagctcttccggcagatcgtcctgctgccagatacgggcgataccttcgaggtattccccggtgcgctcagcgtgttcgctggcgagctgataacgacccgcaccggcgtgagtgtccagatagagaaaaggcttctctttttctttcagcgattcaatgatcaggctttgaacggtatgtttaaggacgtcggcatgattgccggcgtgaaagctgtgacgataactgagcatgtagcgcgttccaatgacctgaaaagaagtatgccgacagtataccgaaaagtggccgccaccgcgaaagcgcaacgtccggcattgaaattaactacactaaaccccataccagaccttatcggaaaaagcgctgatcgggcgcttaacttatttattaaccaggacagcgcttatgaccaatccattactgacgcctttcgaattgccgccgttttccgccatcaaacctgagcacgtcgtacccgctgtcaccaaagcgctggacgattgccgcgaggcggtagagcgcgtggtggcgcagggcgcgccttacacctgggataatctctgccagccgctggcggaagtggatgaccgtctgggccgtctgttttcacccgtcagccacctgaactctgttaaaaacagtccggaactgcgcgaagcctacgagcagacgctgccgctgctgtctgaatacagcacctgggtcggccagcacgaagggctgtaccaggcgtaccgcaatctgcgcgatggcgacgcctataacgaactggatgtggcgaagaaaaaagccgtcgataacgcgctgcgcgattttgaactctccggcattggcctgccgaaagagaaacagcaacgttacggcgaaatcgccgcccgcctgtccgaactcggcaatcagtacagcaacaacgtgctggatgcgaccatgggctggtcgaaactcgtcaccgatgaatctgaactgtccggcatgccggaaagcgcgctggccgccgccaaagcgcaggccgaagccaaagagcaggaaggctggctgttaaccctggatattccaagctatctgccggtaatgacctactgcgacaatcaggcgctgcgtgaagagatgtaccgcgcctacagcacccgcgcctccgatcaggggccaaatgccggtaaatgggacaacagcccggtgatggcggagatccttgccctgcgtcacgaactggcgcaactgctgggcttcgacagctacgcgcacaaatccctggccaccaaaatggcgcaaagcccgacccaggtgctggatttcttaaccgatctggcgcgccgcgcccgtccgcagggtgaacgtgaactcgcccagctgcgtaccttcgccaaagaagagtgcggtgtggatgaccttcagccgtgggatattgcctactacagcgaaaaacagaaacagcatctgtacagcatcagcgacgaacagctgcgcccgtacttcccggaagaaaaagcggttaacggcctgtttgaagtggtgaaacgcatttatggcatcaccgccagagagcgtaaggacatcgacgtttatcacccggacgtgcgtttcttcgagctttacgatgagagcaacgaactgcgcggcagcttctacctcgatctgtatgcccgtgaaaacaaacgcggcggggcgtggatggacgattgcgtgggtcagatgcgtaaagcggacggctcgctgcaaaaaccggtcgcctatctcacctgtaactttaaccgcccggtgaacggcaaaccggcgctgtttacccacgatgaagtgaccaccctgttccacgaattcggtcacggtctgcaccatatgctgacgcgtatcgaagcggcgggcgtgtcgggcatcagcggtgtgccatgggatgcggtcgagctgccaagccagtttatggaaaactggtgctgggagccggaagcgctggcgtttatctccggtcactacgaaacgggcgagccgctgccggaagcgctgctggaaaaaatgctcgccgccaagaactatcaggccgcgctctttatcctgcgccagctggagttcggcctgttcgacttccgtctgcatgcagaattcagcccggagcagggggcgaaagtcctcgaaaccctggcggaaatcaaaaagcaggtcgcggtcatcccgggtccgacatggggccgtttcccgcatgccttcagccatatctttgccggtggctatgcggcaggttactacagctacctgtgggccgacgtgctggcggcggacgcctattcccgcttcgaagaagaggggatcttcaaccgcgaaaccgggcagtcgttcctggataacatcctgacgcgcggcggttccgaagagccaatggagctgttcaaacgcttccgtggccgtgagccgcagctggacgccatgctggcgcattacggcatcgaaggctgacagtagcgtgaaaatttgtttgtcagatgaatcaggcaccggagacggtgccttatctgttcttgcggcccgctgggcgctggagcatgacgcggataacctgatggcgctggtgctcactccgacgcatcttgagctgcgtaaacgcgatgagccaaagctcggcggcatctttgtcgattttgtcgaaggggcgatggcacaccggcgcaaattcggcggcggacgcggcgaagcggtggcgaaagcagtcggcgttaagggcagttatctaccggacgtggtggatgcgaccgcaggcttaggccgcgatgcctttgtgctggcgtccattggctgtcgggtgcgcatgctggaacgcaatccggtggtggcggcgctgctcgatgatggtctggcgcgtggctatgcggatgcggaaatcggcccctggctgcgggagcgtttacagctgatccacgcttccagcctgaccgggcttgatgaggtaacgccacgcccgcaggtggtctatctcgatccgatgtttcctcataagcagaaaagcgcgctggtgaaaaaagagatgcgggtgtttcagtcgctggtggggccggatctggatgcggacgggctgctggaacctgcgcggcggctggcgaccaaacgcgtggtggtgaagcgcccggactatgcgccgccgctggcgggcatcgccacgcctaacgcggtggtcaccaagggccaccggtttgatatttacgccggaacgccggagtaattcctctctcccgcagggagagaggctatctgaaccttactcgtcttcttcgtcgcgcagcggcacgatcagcatatcaacgtgaacggtattgatcagctggcgcgcggaggacatcagtttgctccagaaatcctggtgatggccgcagaccaccaggtccatatcgtatttcttaatcgcatcgaccagcacctgacctaaatcgccgctgccgctcagggtttcggtgatcggatagcccgcgttggtggacagctcggtcagcgcgtgatgcgtctcttcggagatgcgcttctgcatatcgccaagattcacatcgataaggccggtataaagatcggagtagttaacatcaacatggatcagcgaaaccttcgcattgtaagggcgcgccatggataccgctttctcgaccagaactttgctttccggggagagatcgactgcgatcaggatatgtgtgtaagccataatgttactccttccataagttgtcgatgaccagtgggttagcagctcatcctgcgttgtgctgtgtcccgcgtcctgcatactatttgcgcggggaatgcccggccttaagagtataattgtagaagatatttctaccttataacgcacgatctctgccgtcaatccgcctggctcacgctttactgcaacaaataatcgatttgcaggtcatgattacgattaaccttgtggtaaaaaaattaacggatctcctacactatttaatgagccgtccggataaataaatgtgatcccgctcggtttctggtaacactcttcactgaactgttttcgctgagtatcggggagcgagagtcccgggggatttctccgtgggcggatcgccggggagggggtatggtcagcaccgtcgcgctgttttgggctttgtgtgtcgtttgtgtggtgaatatggcgcgttacttctcatcattacgcgcattgttagtggtacttcgtggttgcgatccgttgctctatcaatatgtggatggcggaggattttttacctcgcacggacagcccagtaagcagatgcgcctggtgtggtatatctaccagcaacgttatctggaccatcatgatgatgagtttattcgtcgctgccagcgggttcgtcagcattttattttaaccagcgcgctgtgtggcctggtggtggttagcctgatcgccctcatgatctggcactgagcataaaaaaagcgggccagtaaactgacccgctttgtatgcttcctgcccgcgcttaaatcagtttcagcgcgatccagtacagtccgccggacaaaataatcgacgccggtaaggtgaagacccaggccatcagaatgttagtcacggtttttctttgcaggccgccgccgtccacaatcatcgtccccgccacggaagaggagagcacgtgcgtggtggaaaccggcatcccggtatagcttgccagaccaatggagaccgctgcggtcatctgtgccgacatcccctgtgcgtaggtcatgccttttttaccaatcttctcaccgatggtggtcgccacacgacgccagcccaccatggtgcccagacccagcgccagcgcaacggccatgatgatccagaccggcgcgtattcgatggtgctcagcatatcgcctttcagcttcttcagcagacgctggtcttcagcgctgacatccggctgcttggccactttgtcggtaatatcagagatacacagcaaaatgcgacgcagctggccgcgctgttctaccggcagtttgtcgtagctttcgatattggtcagcattgctttagcgcggtccagcgcgttaatggcgcggcccggatggcaatggaactcgttcggtttggacgccacttcttccggcgtcgggatcagcggatccacaccggtggctttttgcagcagcgcaggatgctgctggaagtaggtttcgacgttattcaccgcatcacgggtacgggtgatgtcataaccggaggcgttcatgttcaccacaaagcctgctggcgccacgccgatcagtaccagcatgatcaggccgatacctttctgaccatcgttagcgccgtgagaaaagctcacgccgatagcggacaggatcagggcaatacgcgtccagaacggcggctttttcttgccgtctttcttttcacgctctgccggagtcatatgaatgcggtcgcgttttttgctgccgttccagaaacgacgcagcaaaaataccagcccgcctgcgaacaccaggccaacgattggcgagataatcagggagccgaagatattgataactttaggaatgttaagcgcgtccaccacagaagagccggtcatcagcgcattggttaaaccaataccgataatcgcgccaatcagggtgtgagagctggaggccggcagacccaggtaccaggtgccgaggttccagataatcgccgccgttaacattgagaacaccatggcgaggccatgcgccgagctgacgttgagcagaagatccgttggcagcatatgcacaatcgcataggccacgctcagtccacccagcagaacgccgaaaaagttgaacaccgcagccataatgaccgcgagttgagaacgcatcgcacgggtatagataaccgttgccaccgcgttcgccgtgtcatggaagccattgatggcttcgtaaaacaggacaaagaccagagcaagaagaagtaataacccggtatgtaaatccaggccggcaaataaatgtagcatatacgttacgccattttgaggtcatgaacgcggcgcattatcgtggacaaccgcggtgcggggaaagtgaaatatagactttttttgataattttccttaggttgtaaaagcgtaaaaacaattatcttttatttttcaaatagctgtcatcgaattgacatatttttgctggtgcgaccagcggcgaaaatttacaattcgccgctcattaatcaagaggatcgtcgtgtggaaaggtttgatgccatcgtaattggcgccggagcggccggaatgttttgcgccgcgcaggccggacaggcaggtaaacgcgtcctgttactcgataacggtaaaaaaccgggccgtaagatcctgatgtctggcgggggccgctgtaactttactaacctttatgtcgagcctgcggcttatctgagccagaacccgcatttttgtaaatctgccctcgcacgttatacccagtgggattttatcgatctggtcggcagacacggtatcgcgtggcatgaaaagaccctcggacagctgttctgcgacgactccgcccagcagatcgttgatatgctggtggcggaatgtacagcgggaaaagtagtgatgcggctgcgcactgaagtgcttgaagtggcccgcgatgacgacggttatacgctgacgctgaacggcgataccgtcagcgccgacaaactggtgatcgccagcggcggcctttccatgccgggcctgggcgctacgcccttcggctataaaattgccgaacagtttggcctgaaggtgctgccgacacgggcaggcctggtgcctttcacgttgcataaaccattactggagcagttacaaacgctttccggcgtgtcggtgcccgcggtgatcgaggcggaagacggcacggtattccgtgaaaacctgctcttcacccatcgcggtctgtccggcccggcgatcctgcaaatttccagctactggcagccgggtgaattcgtcaccattaatttgctgccggaatgcgatcctgaaagcgtcctcaatgagcagcgggcgggacatccgaaccagagcctgaaaaacacgctggcgatgcacctgccgaagcgccttgtggagtgcttacagtcgctgggacagatcccggatgtgaccctgaaacagcttaacccacgcgaccagcaggcgcttattgaaacgctgacccggtggcgggtgcagccaaacggtaccgaaggctaccgcacggcggaagtgacccttggcggcgtggatacccatgagctgtcgtcacgcaccatggaagcgcgtaatgtgcctggactgtattttattggcgaggtgatggatgtcaccggctggctgggcggctataacttccagtgggcctgggccagcgcctgggcgtgtgcgcaggcactcagcgataaataaattttgatagactcaaaatatttttagcaaatagcccgataagaatcgggctattttatttctccgcttttccgcagccattaattatataagcgttcactgctaactaatttataaaattaaagttattgagcgttatgccgttatccattctatacctcccctacctgagtcatatttatcatgctatggaaaaccacccagggtcgttttagcctgcttcttgttggatttttctttattttagtgctggttacgtttttcgtgattaagcattttgtctcgccgcaaattgtcgccacggaaacggaactggttcgtcataccgttgccctgcaaagtaacgctattaaagaacaaatgaaccgcgtgaaagcgcagcaaaaaacgatcactgaacttgtcggcaccctcgacagtgcgcagatcgatcaactgctgccaaatttggtaaaccagtatggcgatcagaatgtgttcggcggcggtatctggccattaccccgtctgcgcgatcctgagcgcgagaagttcagcaccttctttgcccgcgacgctggtggagtactgcaggtcaataccgtgtggaaccagccggaagcagataaatactgggagcaggcctggtataaagacggcctgaacgccgccaaaggcgaatgtgcctgggcgcgtgcttatcaggatgctgccagcccacagccgcggaccaactgcgccatggcgatatggcgtgatggtaaaccctggggcgtggcgaccattgacgtgacgctcggctttttcaatcagctggccgcagacatgagtaaagcggttgagggtaacgttctgattattgagcaggacggaaaaatcgtcggtaatggcgcttccacagaaggcggcaaggcgctgaataatttacgtgaccttaatctgccatcttctcaggcattattgtcgctgctgaataccggccaacaaaagtcttatgaaggaaagtattctggatcggacggtgagcacgcgttatttgtgctgcccattgaaggcagcccctggttcctggccgtcgatctgccagccagtaagctggagcaggcatcgaattctattctgaccaaattaactattgttcagttaacgctggggatcgtcttaatcctcgtcttaatgatttttgtgcgcaatattttcagaaacgtcagcctgttaaataacaatatccaggcactgtccagaggtggcgctgacctgacccaacgcttaaccgagagtaaaagcccggaatttaacgctatcattcagaacttcaatgcctttattacctatttgcaggaattaatgcagcaggtcgggcaaagcgcgcaggcgatctcttcggcatcgcgccagatcgctggcggcaaccgcgatctgtcagcccgtaccgaagatcagtcatcgtcgattgtggaaaccgcagcctcgatggaagagctgaccagcacggtacgccagaacgccgataacgcgcaggcagcaaataagctctccagccaggtatcgggcgccgcgcgggaaggggcctcggtggtgaacgaggtggtcagcacgatgagcagaattaatgactcatccgtgaagattgtcgacatcatcagcgtcattgacggtatttcgttccagaccaatatcctggcgctcaacgcggcggttgaagcggcgcgtgccggtgaaaacggacgcggcttcgcggtggtcgcgggggaagtgcgctccctggcacagcgcagcgccacctcggcgcaggagatcaaaaagctgatcgaagagtccgttgcgaatatcgagcagggcggaagtctggtcaggcaggccggcgtcaccatgaacggcctggtggaaaaagtggaaagcgtaaccaccttaatctctgagatcagctcggcgagcaacgagcaaagtaagggtatcgatcagattaatatggcgattaaccagctcgacagcaccacccagcaaaacgcggcgctggtgcaggaagtagctgcggcagcgcaatccatggaagaacagaccgttcagctggaaaaaatcgttaccagctttaaaatctaagccccgtatgtccagcggtgcctgaccgggcaccgctggctcctcgcattaaaaccttatcttcccaacaatcccaacacactactgttgctattcattgattccgtcttgcatgttaagcgtaaattttacaccttcatgtaattttctgtggccgatgtcattatgtataaagcggatgaatagttattgactttttataaaagcataaatgtcaattatataaaatatttgtttgcgggctaaataagcatgcttttaattcattgcttttataaattcattgtcgttcatttattatataaatgcatttcgcgtcaaattcctaaaaatagcttttttagtacgtgatggtttagccatgtcacagggagtggtattttattacgtaattcctttcgtaaagtattacatcgtcaggaagtgagcctttagcttacgatattccttcgccagtatataaggagtctgttgtgtcaaataattcgtttcaatcggaaatacctaaagcgcgcgtcaatattaaacttgatgtccacaccggcggtgcgcaaaaaaaagttgaactgccgctcaagctggtcgtgatgggggattacagtaacggtaaagaagaacgcccactttctgaacgtgaaaaagtaaacatcaacaaaattaatttcaacagtgttcttgccgatttctctccttctcttagcctgactgtagaaaatacccttgcaggtaacggaactgaagaaagcgttcatctctcctttaaagaaatgaaggattttgaaccagaacaagtggcacggcagatcccccaacttcgcgccatgttggctatgcgtaaccttttgcgcgatttgaaatctaatctgcttgataacgttaccttccgtaaagaactcgaaagcattctgaaagatcccacgttaagtaatgagctacgtgaagaactgaatgccctggcgccaaatgaggcgtaattccaacctttaacggaacaatgcgagataatgcttatgtcagtcaataccgaaaatgcttcagttgctcagactaccgtacttgagcgtcctgaaggtggcggggtatatgcttccctgtttgaaaagatcaatcttacacctgtttctgaactgaacgacctgaacaactatcaggatggttcagctcttgccgatgtaactgcagatcaacgtgtaacggccgctgttcaggtatttttggagcgtctgaaacagtctggtcagactgttgaaagactggataaggctttgctggatcatcacattgccgagctcgatttccagataagtcgccaacttgatgttgtcatgcatcatgaaggtttccagcaggtggaagcagcatggcgtggcctaaagtcacttgttgatcgtaccgattttcgtcaaaacgtaaaaattgaagtgttagatatttccaaagatgatcttcgccaggattttgaggattcaccggaaattgtccagacgggtctctattatcatacttatattcaggaatatgatacgccaggtggagagcctataggtgcgatcatttcaaactatgagtttgatgcctctgcacaagatgtcgcgctattacgcaatatttctaaaatctctgctgcagcccacatgccctttatcggttcagttggcccggcgttcttcctgaaaaaatcgatggaggatgtagctgctataaaagatattggaaattattttgatcgtgcagaatatattaaatggaaagcattccgtgaatcagatgatgcccgctatataggtctgacaatgcctcgagtgctcggccgcttgccttatggaccggatactgtaccggtacgtagctttaattatgttgaagaagtgaaaggccccgatcacgaaaaatatctgtggacaaatgcttcattcgcctttgctgcaaatatggtgaaaagtttcattaaaaatggctggtgtgttcaaatccgtggccctcaggcggggggagcagtaacagatctccctattcatttgtatgatcttggcaccggcaatcaggtaaaaatcccttctgaagtcatgattccggaaacccgcgaatttgaatttgctaacctgggctttatcccgctgtcctattataaaaaccgcgactattcttgcttcttctctgcaaactcggctcagaaacctgcattgtacgatactgctgatgcgactgctaatagccgcataaatgcccgtctaccgtatattttcctgctttcccgaattgcacattatttgaaaatgattcagcgagaaaatataggtaccaccaaagatcgtcgcttacttgaattggaattgaatacctgggtgcgtggtctggttaccgaaatgaccgatccgggtgatgacctgcaggcatctcatccactacgtgatgcgaaggttgttgttgaagatattgaagataatcccggtttcttccgcgtgaaattatacgccatacctcatttccaggtggaaggtatggacgttaacctgtcgctggtttcgcagatgcctaaggcgaaagcgtaagcgggggaaggatgaaaatttatcgtccgctatggactgacggggcctttctggccccacaacagtttcaacagcaggctcgctgggatgcttacgtgactgatgctgtcgcccatatggcactggcgcatccatggggtgtggttgaggcagattttgatcgcggatcgctggctttatctcgcctgaatgcattgcgtctgaaagtgcgttttcctgatggcactgtaattgatactgaactcgcggataacttaccccccgtctgtgatttatcttccgtggctgatcgtgacaacatagaggtggtgctggcattaccgttgctttcagcaaatggcggaaaccttgacgatggacaggacagcgcgcgtcctcgccgctggcggcaggaatgggtgacggtacaggaactttccggtcatgagcgcactgaacttgctgttttacggcatgccgttacgttgcgctttgcacatcaggataacagtgcctatctcatttgtcctgttgtgcgccttatccgtaacgttcagggacagtgggaactggatgataatttcataccgccaatgctttctctgtcagcaagcaaaaccgtatttaccgagctgggggatttactccatcggctccaggctcgacgtcgtcgtctgatggagatgcggcgtgaaagtaatgaaaggatggccgattttgccgtcgctgacgtgtcgctattctggttactgaatgcattaaatagcgccgaaccagtgctaaatgagctttatcaatcaccctctcgtcatcctgaacttttctaccgtgaactcgtacggcttgcaggtagtttgttaactttttcacttgagtataaggcggaggttatcccggcctatcagcacaatagtccggagcaggttttcccaccgttgtttaacttgttggactctctacttgaagccagcctaccttctcgtgtgattgcaatagaactgagccttaatggccagttctggacaggctctttacatgatgcccggctccgtgagggggctgatttctacctttcggtccgctcaaatatcgctaaccaccttttgcaaactcaatttccattgttgtgtaaggctggtagctacgaagacgtctcagatgtggttaacgttgcacttagcggggtagtcatgaagcctctaacccacgtgcctgctgcaattccattacgcctggaaaaccaatatttcgcacttgatcttaatagcgccgctggtcaggccatgctggattcaggtaactgcgccttttacacgccaggttctctgggagaagtaaaacttgaactgtttgtggtgctgcgctcatgaacaaaataaatacatctgttgttgatgcgattttttacccctgctggctgatggtcagccaactacgcagcggagaggaaattaaagatggtgaagcgctttatcggcgtgcttgtgagtgggttgataaggcacgtgaagcactaactcaggctggttttagcgacgccagttgtaatcatatgctttatacgcagtgtgcactacttgatgaaagcgtgatgaatcgtccgcaccaggatagtggttctgcaaaatggcttaaagatccgttgcaagctcgctatttcaacacgcttaacgccggagaagaactatgggagcggatccgtactgtattacaggagccagcacctgacattgctgtgctgacctgtttttatcgcgcgctcacattaggttttgtaggtcgttaccggcagcaaggagacgaacgtcgggaggatgtggtacgtaggctgagtcaccaagtaccaccatttaccatggctcaggaaacgccaattgtatccagatccatgagtttacgctccgggcgcaaagtttactggttctcgtggggggccgggatcatgattttggtggcactgtggttgatgcttcgcagtgaacttacgcagatggtctcgaacctggctgggatgcaatgacatatgcgtagattaactcaatcattgctgctgcttactggtagtgctctggcgctatggttgatccttggcttctggccgcttgccaccagtagccgcactgcgctcagtatggcagttattatcttctgtaccataagcgggtatgtactctggcgcagagataaccatcatcacattgcctatgctcatatcagccatatcgatttaccacctgaagattttgttggtgctgtagtgttagtttgtggagatactacatctctgttttctccatccgtatcttttcgggaagcccggcagggctggtatctggcggtgcagttgccagaacacttgcctgctcttgcccaacatcttgcaactgaacgaccagcacttattgcgcgaatttctgtgctgctcgcacttgtgccagagcaccatcagcgactggatgatctcactcagtcgctacgtgcctggcaccgggccattgtgcagtgtaaagcatggttttccggtattcctcctgtctggatcaattgctggctttcgccgtctgaaccttcctcgcaagaggcagaacgttggtttacggtgacaccagttcaaatgggtattcatgtacgcgaagcgggggctggtgtaatgcctctgcgtgaatggagtcacctgagggatagtgaaaagagtcataaaagacttagcaccatactgacggtagaaagccttctaagttggtttcatattcacgtcacgaatgttacaggacataaacaaggtgaactcccgccgctaatcccctgtgtttgggggtgctgcttaacacctgttcaaggagtagagaataacctgtggcaggcacacatcacagccataaccacccttcggcctgcaataaccggggctgtggattacctcccgttgccagatgttttgctaccgtatctttctcgtcgaaatggcgtgtcccgcctgatgcaagtctggcaacagattggtctactttttggaacatttttgttattcgcgatgctggcttcgtttcttaataaccagcgcctggtccagagcattggggatcacttgtcacttttttaccgccttcctccgttacctcctacacctaaagttcatgcacagcagcaactgcgtgcagatgctcatttgctggatgaatggttaagagcgggagcgccgatgcgtctgtcgctgggtctataccagggaatgcgattgatagcccctttacaagctgcaatcaacagctgggcagcaccgcctccagtagtccagaaaatcgtacaggggcccaggacgataagtctggacagcctgtcgttgtttgacgtcgggaaatggcaactcaaagctggctccaccagagtattgatcaacgcattggtggggataaaaggccgtccaggttggttaattgttgtggcggggcataccgatgataccggagatgaaactgctaatcagcttttgtcgcttaagagagcacagtcggtacgtgactggatgcgggatacgggtgagatccctgaaagctgttttgccgtccagggctatggcgaaacacggcccctgaaaactaacgacacggaagaaggccgggcagccaaccgccgcgtcgaaatcagtctggttccacaggtaaacgcctgccggataccagggaaaaaagcagtgtcaccggatgtaagtgacaccttaatgcaataaatggagaaataaataatggcaattccaatttatctttggcttaaagacgacggcggcgcggatatcaaagggtctgttgacgttaaagatcgtgaaggcagcattgaagtcgtggcacaggatcacagcctgtacattcctacggacaacaacactggcaaactgacgggtacacgcattcatacccccttcctgtttaccaaagaaatcgattcctcctctccgtatctctataaagcggtaacaaccgggcagactcttaaatccgccgaatttaaatggtatcgcatcaacgacgcgggtcaggaagttgaatatttcaacaccaaactggaaaacgtcaagctggtgaaagtcgcaccgaaaatgcatgacatcaaagatcctgcgatggaaaaacataaccatctggaaatgattgaactgcgttacgaaaaaatcacctggacctataaagacggcaacattattcattccgactcctggaatgaacgtaccaccgcataacacctgcagcagacggcgagccgtctgctgtttttgttttctgagcggcctggtagcgaggcagttcagaaaacaaatacaagtttttatttcgacctgatgcgctttggttcatagcgacgggcggtagcataggcactcaaggagaagtgaacatggaacatcagtcagcagtcttgcttcgtcgtattaatccgtactgcgctaaagcgctggaagccgcagccacattgtgccagacacgggcgcatgctgaaattacgatagaacactggctgttaaagctgtttgagatgggcgagggcgatataacggttctggctcgtcgctacgagtgggacatggacggtatatggcaaagtttgctggggcatctggatgcttcgccacgctcggtgcaaactcgtccgcaattgtccgccaatctcgaagcattgatcaaggccgcctggcttgccgcctcgttgcaggatgatagcccgcatataagaagtgtacacctgctggaagcgcttctttctcagccgggattattgagctgtgaagggttatggccactttttagccttagcaaaactcaaataaggcgtctgaaacctttactcgatgcccagtcagatgaacgtccggaactgcaacagcaggagattctggaccagatgccttcaactcttgcgcgtgacgttccaaaaaatacggggatctcctccgataatttaagcgaagcattacaggctgcgctggataaattcaccctggacgtaaccgccaaagcaagagctgggcagattgatccggtatttggtcgtgataatgaaatccgccagatggtggatatactttctcgccgtcgaaaaaataacccaatactggttggcgaaccgggagtgggaaaaaccgcgctggtggaaggccttgcgctgcgtattgctgatggcgatgtcccggatagcctgaaaaccgtcagtttacgtaccttagatcttggtcttttacaggctggtgctggtgtaaaaggagagtttgagcaacgtctgaaaaatgtcattgatgcggttcaaaactccccatggccggtactgctatttatcgacgaagcccacactatcatcggtgcaggtaatcaggccgggggggctgatgcagcaaatttgcttaaaccagccctggcgcgtggtgaattgcgcaccattgcggctaccacgtggagcgaatataaacagtactttgaacgcgacgcagcacttgagcgccgttttcagatagtcaaagtggatgaaccggatgatgaaattgcgtgtttgatgttacgcggtttgaaatcgcgttatgcgcaacatcatggtgttcatatcactgatgaagcggtaaaggcagcggttagcctgtcccggcgctacatcaccgggcgacagcttccagataaagctgtcgatctgcttgataccgcatcggcacgcgtacgcatgagcctggatacccttccggacacgttaatccggcttgcggcacaaatcagcgccctggaaacagaaaagcaagcattgctggaagatattgcattgggcagtagtggctctaatgaacggctgggacaaattgaaaagtctacgaatgaactcatcgcgcaacgtaacgtactaaacattcaatatctgcaagaaaaaacactcactcaacaattgcttgcaacacgacaggacatcagtcgtcaggctgaaattagcagtttgcaacagcagcttactgaattacagaatggtgctcctctactttcgctggatgtagacgtacgtaccgtcgcaaccgtaattgctgactggacaggtgtgcccttaagcagcttgttaaaagatgagcagaccgacttactcatgcttgagagccatttaagcaagcgcgttgttgggcaggatcaagcactggtaaatatggcgcagcgtctgcgggcagcgaaaacaggtctgacgcctgaaaatggcccgttgggggtgtttctgcttgtggggccgagtggggtgggtaaaacagaaaccgcccttgccttagctgacagcctgtttggtggtgagaaagcgctgattactattaacctgtcggagtatcaggaagcgcacacggttagccagttaaaaggctcgcctccgggctacgtcggatatgggcagggcggcatattaactgaggccgtacgtaaacgcccttacagcgtcgtgttacttgatgaggttgaaaaagcacaccgtgacgtaataaaccttttttatcaggtttttgaccgtgggtttatgcgcgatggcgaagggcgtgaaattgattttcgcaatacggtgatcctgatgactgccaatctcggcagtgatgcattgatgcaaatgctggatgaacagccggatgcgagagatagtcaactgcacgagctgttgcgcccaaccctgcgcgatcacttccagcctgcgttgctggcgcgctttcaaacgttgatctatcgtccccttactgctgttgcgctgcgtactatcgtgaaaatgaagctagaccaggttgcgagccgtctgcgtcggcattatgggctgtcctgcattattgaagaaagcctttacgatacgctggtcgccgcctgcctgttgccggataccggtgcgcgtaatattgacagtttgctaaaccagcaaatcctgcccgtgctgagccagcaattactgcaacgtaaggctgagcaggtacgtaccgaaaatctgacactggggtggaatgaagaagcggggattgtgctggaatttgatcatggagtaactgaatagagcgtgccgatgatacagtaaaaatgcatggtggttatttattatcctgaataattaatttctataaatatgttgtagccatctcttgaagcagtgtggagaattttcatggatagcgcaaaagaaattgcacaagatatgcttgaagcaatcaacgtggatgggggaggttttttaggcgcagtcgctaagggttttatctcgtttcctgtcagcttatattatcttggctatgatttcatgcatactgaggatcgcagagaaaattatgaagataagattagagttgccaggcttgtaaaatctgacaacatcaataaagaaatactagagagaatcatcagtgactttatggatgagttttcatcacgcgtagatatagaaaaagttgttagtatgattaaaaatactactggcacaattattggcaaagcgttatttgcacaactctttggggttaatctggggaagatattaacaaaccatgctattacggctttttttaagaacagatgctggagctatacttacagtcggtgctgaagcatcctgagcgatttatgtatcacgatacttacgtgacagaaacccttccttttactataaattaaaatatatgggaaacttggatctattatattatttggttgaggatattgtgagaccatttgaagcagtctgcgacattcatgacaaaaatcaagcagactttgataatctttgcaagtatttctttggtggtttatgaacttaaaaaaggttgtagtttttgttttttcatatttcgcctgtgctgtcgcaggagcattggttacatttggtttgatttttactgtttggttcttttttttctcaaaaagtgaagattctttattttggtgtggagcttcgatgttgctaatttttctggggtatataatcaatcgaattgcatttcctcatatctagagcgttttctaaatactcatttattcccgtagttaggttaaatgttaatagccttaaatcctgcatgtgctcagtaagaaattattgtcaaaaggctttgccgtttaagaaagaaagtctgatacctggattgtccagaggtaaggttatgagtgactcattagatgaagatcttggtgaagatgccatatgggatctttacaaaaaaatcttaagaggcttttcgtggtgatattgaaactttttttgtaaaatttttggtattgcttttaacaatattagtactgacgggatgtccggggggaggagatagtattcttcctcgttaagaagcaaaattaaatattattgataataagttttatttttgggtcgaaggcacagtcgaatatcagatagcccatatttccatcaaccccagaggaacatcttttcgtcgccagaaggtgtaatttaatccgcaaattaaaacgttgaacgggaaattatgtatcccttcatcattcttcctttttcctgaacatggacagtttttagttgaatatgtattgtcatcatatagctcttcaacaattatagttacaggagttaatttttaaaatgtggatgtcaggcttattcaacttacgaaggatgaagtcgtaagatagttgatcaaattttatttaagatctccgtaccttttttatcaatgaaattttcactgtgtttttaaaatatattatttgaattttttatttcattatgtaaataagatgttaagttagggattgcactggaggtgtatgatgaataggaaaaacaagaatgaatttaatgaggggggagtccgactattgagtattggtgagataaaattggctaaatctgtttttaagtccactatagactacagcaccgtgtggatccataaggaaagctatttaccgtttaatcttcaggataaaaaaactgcgatggcgcctaatggtgaaatctattttcgtgatttttatagagatgatttctctctgtccacggatgatattcagcacctgtttattcatgaaatgagtcacgtatggcaacgtgcgaagggaatgcatgttattacaagaggcttgattagctggctggtttcttatcgatatatgcttgacggtcggttgttgagtgagtatcccatggagcaacaggcacaaattattgcggataattttactttgcaaacccatggatatgcagtgtggtatcgtttgtggagtaataaataccccgcggtgacgcttgatggagaaactgctgaagcagtcgttcggcaaaaatactgggaggcgttacgaggattcccatggtgaaactatcaaaattccgctctggttttttagtaggggggattttcctcagccttagtacacttacgggttgtcctggagtaggtgacaggatggaatttgatgaaagcgcagaggtcagtgttaaaggcaaggatgtctgctttgaagtcatagatccgcaagattatcagccggtagatatggctatcaatccgcgagggacgctttcaataaataaaagaattatttttaatcctgccctgactgttattaaaggggagttatgtatacccccttctttttatgatttccccgataaaggacaattcattgttgagtatactttaacgtcaaaacaaaagagagaaaaatcaagaaaagtggtggttgtcttgggtgttgcggatggcaaaatctataatatgatacctgccgataatgaaatctccagaccttatgatgaattaagtcaataaaaaggcatgagtattagacggcgattcgaataaattttctatccttaaataattaaaatcccggtaagtatatggagtaaaaaccatgagtatcattgatcagaattcaactttgcttaatgaaacgctgaaccgctttcgacttgttattccttcatgtacttccaaacttgatgtggaggaattcagcggccgagaggtattaagtcaggtgtattattacactattgttttcaccacaccagataaagatattgatgcgtcccaggtattgagaaaacctgccagtcttactatgggcattggtctgttacacagcctaacggaagataaagtagtacatggtattgtgagcgactttcgtcggatatcaggctctaacgacgaggcgcaatatattattactctggagcccttcctggcattgctgggtaagcaaatacgtactcatcgcttctttgtcaataaatccgtacctgacgtagtggcacagatcctggatgagcatggtttcaaaggttgggaatacgaattcaatctcaaacaaaattatcccaaacgtgagcagatcaaccagtatcaggaaagcgacctggcgtttattgagaggttactttctgaggtaggcatattttatttttttactttgcaaccagatactcataccgaagttgttcactttgcggataaacagagtgcctatgaatttgataaaacactccctctgaacagcccgtcgggaatgagtgataacgcaaaggagtcggtgtgggggctgaacattcagcataatgtggttcaggcgggggtgatagcgaaggattataatcatcgcgaagcgcagaaagtgttgcagtccgccagagcggatatgacgcgccgcgacggggcagatataacctacggagaggtttatcactacaaaccacgccatcttgaaaccggcgataaaaatgatccatctgctgaaacagctaatttcctggctcgtcttgatcatgaacgctttctggcagatcagacccttattaccggcttcagtacagatgtaaccttgcgacctgcacaggtattgacggtaaaggacgataccgttccctccacattacctgagttactgagcttaccgatggtcgtgatacgcactggatttatggccagtcgaaaagatgcgctcaaggtaacgcttgccgcagtgccttacagcgaaaccctgtgctggcgtccaccgttaaaaccccgtcctacaataagcggtacgatgatggcaagagtcaccagcgccagggcagacgacatttatgcctggcaggatgcagccggactgtaccgggtaaaatttgacgccgatcaggacgacaaagctcagggccaggagagcatgcccgtccgccttgcgaaaccctacggcggtgacgtatacggatttcacttcccgctaatccagggcacagaagtagctattgcattccacgatggtgacccggatcggccatacatcgcccatgccctgcacgactcccggcacgtcgatcatgtgacagaaaagaataatacacgcaatgtgatgcgtacccctgccaacaataagttccgcatggaagacaagcgtggcgaggagcatatcaagctcagtaccgagtatggcggtaaaacacagcttaatctcgggcataacgttgatgccgcgcgtggtttgcgtggtgaaggagcggaactgcggacggatgactggatttctattcgtagtggcaaaggcatttttctgagcgctgatgcgcaacctaaagcgcaggggcagatgttagatatgggggcggctttagcgcagttacaagatgctttgcaacttgttaccgctctggcgcaaagtgcaaaggtatcgggtgcgctggaggctgatacgtcttctcaaagggagcttaatcgtgctctttctcagctacagagtgcagggttgttggcatcagcaccggcgggaattggtttaacaacgccaaaaaatatccagctctctgccggacattccctgaccgctacagccggggaaaatatcgatatgactattttcaggaagcttacggtagccgcaggtgaagccatcagtctgtttgcacataaaatgggaatgaaaatatttgcggccagggggaaagtcgatattcaggcgcaaactgatgctatgagattgcagtcagataaaacgatgaatatgaatagtgttaatggtgaaattatccttaatgcggctgaaggaataacgcttacaagtaagggcggtgcttacatcaaaataaaagacggatctgtagaaatcggcgcgccggggagaatagagttgaaaagcatgaatattctctggggaggaattgcttcacttgaacaagctctctctcctgttgcggtaagcgacccgcagtttcataacccaatgaatggtagttttcagattgttgatgaagttagtaaacagccaaagccatatataccatacagaattgaaaccgaggatgggcagattatccgtggtgcaacggatgcaaatggctacacgcaggcacattatggcattgatcctaaggcaataacgttgttctttgaataaccagggagtgaaaaatgagtgagcaagggaaagctgcagccgaacacaaactaagtaaatccgaaagtaatgtgaaggtcgttacccataagtcttgccagtgttatttcagaaccgaaacgctacaactaatattcattgatgaagctgaagttgccggttttgaaaaggcaatggataaactttgcctattgatagatgagcatcataaaacaaaagctaattattctgaggcgattgaaaattacggtatccgaaaaaaggatattgcaaaccaaaatgatttatcagaatacaaggctaagatcgccaacacagaggctttgcttaagtctgccactgaaaagctacagcaagagttaggcgattttaatgagcaaacgggatattcagcagtggtcgagctaattcctctgcaaccgcttaaaaaaagtaagtatggacgtcgttattcatatattaaagagtgcgattttaaaaaattcgaagataagttaataattattcctgtcgatgtttctgctgatgatggtatattcaagaaagatgatgatggaaatattatcggaatcgatatcgattcgttaaagacaaaactggcagcagcaaaaaataccattaaacaaatgatggatagcaccatgacgatgagtgctgatgtggattatgaggcaacgctgacagaatgggctgacgcatggaacagtgagtcaggcgcatacaataaagaaggccactatattgatgtttcagccggggcgcagtttctgcggtttacggcgaatgcatccacgcttaatacctggaacccggatacaggagcggtacagattaagggagaagcgcattctggtctgacgctctgttctggcacactcaatacaacgctttatgtcccggatcgtacaggctggcccctgaagtttatggtcaatgatactaaagaagccaatatagggattttacgggccagaattgacggagagctgacgggatatgttggagcttctgcgcaggccgaaggcaaccttcagtttgtaacatacaataaaaaacagttgctgatggggaaccgtacgccaggagtcccttttagtgaacgccagaatggggtaaagatcaaagatagcaaggagaatccaaaaagcctggaaataaaagcagaagcatttggtggcgcaaaggctggagccagtcttggcggcgctctgcagtggttaaagccttttagttcactggtcgatgagcttcccagtatgctgcatacctttggcatggattcaccagcactggaacaaatcctgccatctgtaaagcagtcacaagagaaacaaaacgaccaaacgggagagtttcaggattttgcttgtttgaaggtaggcggggatgtggaactgggcgtgggattaagtggtgagtttaagatccgcttcgtaaaaggccgctttagatttcatattaaaggaagcatatgtcttggcccgggagcaaaaggtgaagtagagggagaggtttcacccgaattgtttggagagtttgctatttgggtgatataccaattatatggtatcgattatagacacttaactataattgcagatgatgcatttaaagcacttacctatatacttgttatgggcggcgctgaaatatactctaagtactataataaaatgcgagcagaattagaaggtgtgaagaaggattttgttgattttattgatgacatgacgaaaggtttgatgaaggctcgaagtgattcaactaagcgtaatgattttgcatctttaataaacaaggatcctggctgcgtctttttattttctccagaagcaaaaggtattgcactttatgtgcttactaaagatggcgcatatgatcgtattgatattaacaaccagggcgatggttttctacctgatacaaataaaaaacgcaaaaccgctgtattatatgttttgtccagtattcagaccaaacgcgaatggaaaaaagtgttgtctcgtattagcaaggatggtacagcgctccccggtaatgaagatgcagtagtcaaacaggccgaagaaagtataagaaattttttacaaataggttttaacaaagacaaggagttagaggatattattgataagttagaactgagagaattcaatcaggtcttcaaacggcttaaagaaaatccagcttatggttatgcgttctcacctaattgcactaaacagtactttttacactgtgatgataatccgttttatagttctttatgtcattttggccctgttaactctgaatataaacaaaaatgggaggcaaatgattgatgcgtatttattttatagttctgttattatttgttagcggttgtgataatgcaacggaaactaaaaaacttaccgctgacgaacaggctgaacttaaacagtttgtcaataaaatcaaatcagagcttgtctacgtcaaaggcggaacgttctggatgggagatttctgcaaaaaaatgcgcaatggtggaccttattgttcatcagaaaaggataataaaccattgcatgaagtggagcttgagagttattccattagtaagtttaaagtaactcatgaagactatgacttctatttaaaaatgaaaaagttgccaaaaaagaattttgaaaagaaaagctacaatgaaattttttataatatgatatattttgaaagaagtccggcgattattacatggactgaggcttttaattattgtgattggttaaaaaaagaaactaaaatgcctttttcgcttcctacggaagctcaatgggaatatgcggctcgtgcgcgcggtcagtatattttagtggcaacagatgatggttcttggcggaaaaatgaaaaaacaggatatggtgaaaacttcgctacagatgaggataggtgggcagtagagaaggatttaggcatcgatagtacttctatacatttcccggtagataaatatcctcccactccacttggaatgtatggtatggctgataatggttgggagtgggtgcatgactggtatgacccttattattatgaaaaatccccaaaaaaagatcctcaaggtccagataaacctatagtcaaagatgatgattctggacaatatctgaaagttttacgtgctgtaaatcatcttgtacccggcgcgccagaaggcgttacttttagtcgagcatcgaatattaaagataatccttatccagccagtacaacagtacgttgcgtcgttaattcaccggacccaataaaatgaaccaaaaatccataaattatagcctgtttcttttcttactaatcggtggttgcgacaatgccagtcaggcagtaaaccgtactccacaagagcaggaagaattacagcaatacctcaagcgtataaaaaaagaccttgtgtatgttaaaggcggaacgttctggatgggagatttctgtaaaaaaatgcgtaatggcggcccttgttgttcatcagaaaaagatacaaaacctttgcacgaagtggagcttagtagttattccattagcaagtttaaagtgactcatgaagattataatttctacttaaaggcgatgggtttgccagatcagtatgtaaatgaaaattatcaaaaggagatgctggcaacgatgactcactttgataatagtcctgctgtagtgacatggacagaagcaaataattactgttcttggcttggaaaagttacagggcttcctttttcaatgcctacagaggcgcaatgggaatatgcctcacgcagtcgcgggaaatatataataattgcgacggatgatggcacatggcggaataatcccagtactggattagggggaaattatgctacagatggggatcgccgcatagtggaagaaacttacggaataaatggatcactagtccatttccctgtagataaatttcctgcttcacctttaggattgtatggcatgtcagataatgggtatgaatgggtaactgactggtatgatgatgagtattataaaagatcaataagaaaagatccgagaggtcctaataaccctgtaatgaaggatgaggacactggccaatattttaaggtgttgcgaggcggtgaggcccctggcccaggtagcgaagtggggttcacgttttatcgtgcctacagagttaaagataatccttatccagccagtacaacagtacgttgcgtggttaattctccgcacccgataaaatgaaccaaaaattcataaattgtagcctgtttcttttcttattaatcggtggttgcgacaatgccagtcaggtagtaaaccgtactccacaagagcaggaagaattacagcaatatctcacgcgtgtaaaaaaagaccttgtgtatgtcaaaggcggaacattctggatgggagatttctgtaaaaaagagcgcaatggtgggccttattgttcatcagaaaaagacacaaaaccgctacacgaagttgaattaactggttattcaataagcaagttcaaagtgacgcatgaagattataaatgctatctgaaaattgctgggttgtcagagcaaatttttgcacataaatttgagagcgaaatgttgtctgatatgacttatttcaaaagaagtccggccatagtaacatggacagaagctaatgagtattgtaactggttgagaaaagaatccggacaacctttttcgcttcctacagaagcgcaatgggagtacgcggcacgtagtcgaggtcaatatatcttggtctcgacggataatggcgtctggcgtagtaatgctaaagacggtagaggcgaaaattatgccaccgatgtagatcgtcaccttgtggaggattctcttggaataaatagtatattaattaatttctctgtcgataaataccctccaaactcgataggattatttggaatggcagagaatggatatgagtgggtgctggactggtacgatcctgattattatagccggtctccggtaataaaccctcagggtcccgcaaaaccggttattaaagatgatgatagtgggcaatacctcaaagttttacgtgggggaaataatcctgatccatcaggggatgtcgggttgacgttttttcgaggctacaaaataaaagataatccttatccagccagcacaacagtacgttgcgtcgttaattctccggatccaataaaataaatttccttgatgtgttgtaacgcttttattctaactttttctacttttactaaattttaatttaaattgaaggtgccagtgttggggtgggtaatatagttatttatattttcagtgcaagaacaggtgcagcctattaaagtgctcgtgtaataataatctttgaggttttctcacagtaaatgattatatggaggtatttatatgcttggcgtaatacggatcggagataaaacctctcatggtggtaccgttcttgagggcagtgctggtctcatatttatgggtaaggcagtttcctgtatgctggataaagtatcctgccctgtacatggcgtaacttttatcgcagaaggcgatgttggatctaaatggaatgggcgtcctatcgctttgcatggtcatcggtgcggatgtggttgtacactgattacctccctgccaacggcggggaaacgttaagctatgcctgtagaaataaggaatttgccagaacctaaagtgttgcctaagcctcctgaaaaaatgcgctggctcgtttttatagctatctgcatgcttactgggtttatattaacactttatttttggccgaaaggtaaaccagcaaacactttttggttctggatatgtgctactttgattccatcggccctggggttaatatgctatgcaataagattacgtcagtatgaacatctggtcgagcaagtttcacactggaaccagttatatgcagaggaattaaaaagcagagaggaagccgggcaacaggcattagggatgctgggaatggcatatgtcacccccgcagcgaaaaataaactggctgctgcattattgttgggtgcaagccctttgcaaactgtttattgctctcgtactgcctcggtggtgagtaatgcactccttcacccaccagctaaaagcaatacggttgcggaatattgctctcgtttagaaatgcacctttacactttgctgcgtatgctgacgcctgagttggaacagtatgcccttaatgagcctgtaacggtgcgtatccgtcacgatcaaacagtaagtgatacctgctttctgagtatatggcaacgcattttcccggagcgatacgctcttcatcctattattttcagacccgacgacgatgggcttatgtggctggatgagtggctggacgagcagagtccgtcacttgtactttctgttgaggtcaatctctttggagataaaggtgataatcaggctgagtcaatttcattgttattactggcttcgccagcgtggataaaggaaaagcatactagtccactggcgtttattcatcgtcctgtatctgtgataaaggcagtagaggatatagatgatgttgtacgctggggtaagctttcacctgatgaaggttattttatctggcgaagtcaactaacgccctccagccagactgaaataattgaggctatggatgctaaaggttatttatttaataaagatcgagagcattcgttagacaattctttcgggaaacctgattttgctgttgggcatattacgcttatttgcgcctgtgaacatgcaagttcttcacaagtaccgcagtggatcatgttagaagataaaatgcctcagtgcgtcattgtacgtccagcgtaattctgcattaaggaaagttaagtgtacaaaaaaagacgatttagcacatggatagttgttattgtattgcttttaattggcagtgcgcttatctggttcgataatcctgttattcacttaccaactcaacaaaaaaaactaattgcttctcttactttgtttgggatttgtttcggatggttgctatgtgatgatttatttttaaggataataaaatctgttgtttcgtcagagtatttccgcgcattaaatatccgcttgattaagcagagtaattcaaagattaaaagccaggctagcgaaaattcttatgtagttcaaatgaaaaaacttcgcgtggctttgcacatgaactatggtcgcttttggcctcgtagagtacgtatcatcctgctcactggcagtatcaatgacgtagagctgcttgccccaggccttgcagaccagctctggcaggaagacagaggtacgctactgctgtgggggggagatccctctgcacctttagacgcggaatggtctgaagccctgagcaaacttcgccgccgccccatagatggtgtggtctgggtgacctctgcgttcgcacaaaagcaccccccctccaacgatatgattgagcgaatgtcacaggcattaacttcccgctgtggcttgtcaggctggcggttccccctgtatgtctggtccctgcacggcactgaaagtaaagatcatgttcgggctactcaggccgtaggctgcctgctttccgtaaactgccagccagaagtgttgcgtaatcagcttgcagcgctggtacctcccttaattgaacaaggaacgcagcagatcagtaactgttccaggcatcaatttttactgcagcttgccggacaactagctgatgacccgaattctgtcgctgaacccctgggcgatttactcatcccctggcaacctcttccgcttgccgggatcatgttcagtccggcttctgcaaataccacgagaacggttcggcaccactgggtaagggataatcgctgggatatcttgctggagtcgttgccttctctgcccactggtcttgtggcgaaaaaacgcggtgttgcttggggccaggtcatgatgttcatcctcacgggcgctatggtgctgtggggggcaggaatggcgacatcgttcctggtaaatcgcggaaccattatctcagcaacatcacaggtcagacgcgccgccgacgaacaacagccgctccctgtgcgtctgcaggcccagctggatttacagcacacgctggatcaactgacataccggcaacagcatggcgctccctggtatagtcgcgctggcctgagccagaacgatgcgttactgatggcgctctggccgcattatggagccaacgcactgcccctggtgcgtgatgccgctgcccggcatcttgaggctcagttaaatactctgttaactttatcgccagataatccacaacgcgaaagtctcatgaaaccagcttatgaccagttaaagctctggcttatgctggcctgcccggaaaaaatggacgcagcctggtttagcaagacgttgctgaaaaactggcaacagcgtcagggcataccggacaatctctggcaaggcagcggaccggccctgctggatttttatgcccgccatcttccctcacatccgtcatggcgtcttgagccaaatacgcagcaggtgagccaagtccgtactctgctggtacgccagatgggcgcgcgtaatagcgacgcttccctctatcaaaaaatgctcgtccaggtggcgaaccagtacgctgatatgcgtttgtcggacatgaccggcgatacggatgcggcacgtctttttacaacggacgaggttgtaccgggcatgtttacccgcaaagcatgggaagaaaccgtccggccagccattgagcggatagtcagtgagcgtcgcgaagaaatggactgggtgttaagcgacaacagaacgaacgccttacagcaggcgtccccggatgcattgcaagcgagccttgaggcgcgttatttcgccgatttctctgcaagctggctggcctttctcaacagcctgcggctccgtccggcccggacgctatcggattccatagatcagctcacactgatggctgacgtgcgccagtctccgctggttgcgctgatgaataccctgagcgtacagggtaaaactggccaacttactggggcattgccggattcgctggttaaatccgcaaaagatttattaaaccgtgacgagaaacctgcttttgatcagcaaacgggcgtacagggcccgctggatagcacttttggccctgtactgtcactgatggcgagtggggacagcatgactctgagtctgaaaactttcctgacccgcgtcactcaggtgcggcttaaactccagcaggtagttaatgcccctgatccccaggcgatgagccgaacactggcgcaaaccgtgtttcagggaaaggcagtcgacctgaccgaaacccgtgattatggcagccttgtcgccgcgagccttggtcaggagtggaatggattcggacaaaccgtatttgttcagccggtcgaacaggcctggcagcaggtactgacgcctgccgctgaaagcctcaatgcccagtggcaggcagcaatcgtcactgactggaacagtacgtttggcgggcgatacccgttaaaaaacaccagtagtgaagtgtcacttccgctccttgcccgctatctcaataacgatagcggtcgtatcgctcactttttgcagacccggctcagtggtgtgctgcataaagagggcagtcactgggtaccggacagtatcagtgcacaagggctaacatttaatccagcttttcttgatgccgtggatatgctgagcgctctgtctgatgtcgcctttgccggaggggaggcgggtattcgatttgagttacgtccgggaacagctaaagacgtgatgcagactgacctggtcatcgacagccagaaactcagctattacaaccagtcgccgttctggaagcggtttaactggccacatgataccgagttccctggcgcaagtctgagctggataagtacgcaagcgggaacacgacagtacgctgatttgccaggcgcatgggggttgattcgcctgctggagaaggctgaagttactccctatccaggcgtaaacagtagcttcagtgttacctggaaagctcctgatggcaggccgttgcattacaccctgcggaccgaggcgggggaagggccgcttgcgctgctgaaattacgtgatttcagattgcccgagcagatttttagcgtaaacagacccggaacagaggacgtaaattaatggcaaccttgacgacgttattaaacgccagtcatgccgatccgcttgtgatttcacaacaggccctacagcaggctttactgtgggaaaactggctggcacctgtttccctggattctccagcgggaagcgatccaggttatgacgatgatttccagcagatgcgcgaagaagtcaataagctatccggcgcagacaccgctttaatctgcgatctggcagagaagttgctcacctcaacctgtaaagacgtacgcgtcgcaacttattacatctgggcgcgactacatacggatggtgaaagcgggcttgctgatgggctgtccttgctggccgcgttggttcagcgttttggaacagccttacatccgcagcgtggtaatagtcgcaaactggcgctggagtggctggcgagtaaccgtatgctggacagcttatctttatatcctgaggtggcaaaagcggactttgagcgcattgtgggtgcgctgcttttaaccgaggaaataacagcgctctggaacgaatcagagcgcccgcagtttggtgggctttatactgcgctggaaaaccgccttgcgcaatccggtggtccggatgcggtgatcccgcaaaacagtagcgccacgattattcactctacttctacgtcggcggaaacgccggtgttgaaaccggttacctccggacgtgacttactcgatcaggcgaaattactggcaaattttttgcgcgatcagccctacggctggttatccgcccatcatctgataaaaagcatacgtctggataccttacacgaacttcctcccctggcagcagacacgcgcacacggctggccccaccgaaaccggaacatcgcgcgatgctaaagcgcctttatttgcaacaaagctggctggaattacttgagcagaccgagagcttttttggtcaggcggtcaatcacttgtggctggatttgcagtggtatatccatcaggcactcagcaaagcaggcacgccttatgaaaaatgggctgacattattacgcatgatttacgcggtttactccatcgcctgcctgggcttgaaggactggcttttagcgacggcacgccctttgccgatgaagtgaccctgaactggatcaatcagcacgttctggtggctgaaggctggcacgatgaatctgcagcttcagccagtacggcgggccacgatgaaatcttacaactggagccagaagccctggcacaggcggacagcgaaggcgttgaagcggcgttgctctggctgcaacatcgacccgcgatgcacacgcctcgtcatcagtggctggtacgtctgctgatggcacgggtcgctgagcaatacggcaagaacgacatggcactgcatttgctcaatgaactggactgcaaggctgccaaattaatgctctcgcaatgggagccagaattgttgtttgaggtgaaagctcgtcgtctgaagctacttcgcatcaaaattagtcgatccgacacggacaaatcacgtttacacagtgaaatggaaaccctgcttgccggattgattgccattgatcccgcaagagcggcagtactgtgtgggtaattgataatgcctggtaatgaaaaatacatgaaagacttaaccctgcgttattacgacgctgaaatacgctatcttcgcgaggcagccaaagagtttgcacaagcacatcctgatcgggctgctatgttggatttggataaatcaggcaccccggatccctacgttgaacgtctgtttgaggggtttgctttttcaatgggccgcctgcgtgaaaaaattgatgatgacctgccggaattcaccgaaggcctggtgagtatgttgtggcctcattatttacgcactattccatcactatcgattgtggcgctgtctcccgccattcagtcaatgaaaatagcggaaaccgtacccgccagtatggaagtttattcgcgccccataggccccaaaaatactgtctgccagtaccgaaccactcgcgcgacggtgctcaatccactggaagtgtcaaaagttgtgatggcggctgagccggacgggcgttccgtgttgcgtttgcggctgacctgcagttcgcaaaccgactggacacaggtggatttaaggcggctttctttttatctggcaagcgacgctcctgttagcagcgcgttgcatctggcattaacccggcgacaggcagcactttatctgcgttttccggatcaagtcgacagggtacaaattgatggctggttttctccaggcggcttctctgaggatgacctgttatggccgaaaggtgaaagcgcttttagtggatatcagcttcttctggaatatttcaccttccgcgaaaagtttatgtttgtacatctcaatgggctggagaacgtgacattccccgttggcatcgctttttttcagattgaagtggtactgcaaagccaatggcagagcgacctgcccgttacggatgaggcgcttcagttgcactgtgtgccggttatcaatctttttccgctggaagcagatccgttgataattaacggactggaaagtgaatatcttttgcggccacgacgtttacaggacggtcatactgaaatttattcggtagatagcgtaaccgggtcacagcgtacctcgggtgctatttacgtgccttttaccagtttccgtcaccggggtgggatgcaacgacgtcatgcaccagaacgttattaccatacgcgagtcaagcgcggggtaacaggtttacatgatacctggcttattcttggcggtgtgcaatgggaggctgaccggcatctcatgcgtgaggcggtatcattgaaaattactggtactaacggccagctcccgcgaaaagcactgcaaagcacgatactcgatcgctgcgagtcagtgctacagacccctctcaaagtgcgtaacctttgtaaacctacgttacctgcttatcctccagctgaggatcgttttcaatggcgggtattgagccatctgggttcaagctatcttaatttgatgagcagcgcggatgtcctgcgtaacacgcttgagttatataactggcagaacgacgaactgaataatcgtcgtctcgatgccatacagcatgtcgcgcaccatcagatccagcgttttgaaaaaggcttcttactacggggtattgatattgaaattaccctcgacagtaatggttttactggcgaaggggatgttcatttattcggtgagatgctcaaccggttctttgcgttgtacgccgatatccacttgtttaaccagcttaccctcattgtgcaacctgccgggaaatgtatccgatggaaagagaaccacaaccagcgtttacccggttaatagagcaactgcgtgacaaactgccttacactcagttttaccgcttttgccagttactggaacaaagtcaaccggatcttccagcgctcggcagcggttggcagatcaagcacgatccagttcgttttcgtccccatccgggaatgggcttcccggccagcgaattcaaaggaatggaaatagcggagcaggctgacgaaccaccgatcatccgcactacctttttgggactgtatggggtggaatctcccttgccgacgtcttatatcgacgatattgcgcagcgcagggaaggctatgaggccgtgagtgattttctggatatattcaatcaccggatgatcactcagtattatcgtatctggaggaagtattcctatcctgcaacctttgcatccggcggccaggacagaacgtcgaaatacttgttgagcttgtgtggcctgggtattgaaggctgcaccaaaagcatagcaacaccagtctcgcgctttttagcgctgaccagcatgatgcgtctacccacccgtactactgaaggcgtggtggcgctggttcagttactggctccggatactgaagccatcgtgcagcctcatgaccgctgtcgtattcccttgcataagccattaacgatgagtgcgcgtaaccctgtcagtatgagcaacagtccgataatgggaacgcacaccatagatgtaaatagccagatcttattgcaactgaggactcataatgctgacgaagctgttggctggcttcctggcgggcaattgcatgcggatttgcacgctttgttgcaggtctatcttggagcacgccttcatgtacgcttacagctttgtgtatgtcgccgtctgttgccggatgcgcagttaacctgtcagcccaaaaagagtagcgtgctgttggggcggacagcggtgatgcgaccacagcaggtgagcataacagaacggcataacgaaaaagttattactattaatctgggtcgctatcagcgtattcaggaggcttttaaccgtagggagacggacgaacatggcgattaccgctggtaaaaagcgttttacattcataacactaattatggtggccacattatgcggctgtggattaacgcaaaaagtgggcgacagcaccgttgctatgaccagggcattatttttcaaacaagtgaaaatactgcatctggatattattgcacgggaggcagctaataataatgcggcaggaattccgctttcaacagtaattcgtatttatcagttaaaagatcgcaaggtgtttgatgatacagattatccatcgttatttgccgaggatagccaggctattaagtctgacctggttgctcaaaaagatattcgtcttcgtcctggtgcctctataacaatagatatgcctctggaagcttcagctaattatgttgcggtagccgctctttttctgacacctgatactgcaaataatacctggcgcgtggtgttaaaccgcgatgagctggatccggatgtggcgcggaagattgaaatgaataatcagacactagctcttctgccgctcaaggatgattagcatggcacaaccctccctttatgaaatgctcaccggcaactttaccggcggctttgatattcatcaggttagcgaagaaaatcaggtcatcatatctgtactggataatatgcagcgtattctcaatacccgtcagggctcgctcagccatctaccggattatggtctgccggatatgagtaaaattctgcaggggatgcctcgcacggcacattctttactggatacgctttcggcaaccctattgaaatatgagcctcgtctgaagcgcatacaggtggtcttgctgccgcagcatatgccgggccaactggaatacgcgatagatgccgagttacacgatttcggcattgtgcgttatgacacggcttttatgccggaaggccgtgtgcttatccgccatctcaggcaacaaaattaccttcagccgggcgacagctattaacgactatcagagacgttatcttcatgactattaatgactataccctgaaaacgggcggtgatccccgcgcgctggctgactttgccgctttgcgggaagaaatcagtaaacttacccatcccgctcgccccgacataagctggtcgagggttgaacaactaagcctttcactgtttagacagaatggcatcgaactccagacggtcgcctggtacacccttgcgcgcacccatctcaccggaatggcaggtctgaatgaagggctggctattttagaagctttacttactcatcaatggggagcaatgtggccgcaaccagtacatgcccggatggaaattattgccgggcttagcgtgcgtttgcaatctgtcctgcgcacgctgagcctgagctataccgatttacccttgatctaccaggcggaacagcatctcactgctttgcgcaatgtgctgcaacgtcttgaactcaaaaatgccagccaaatgggtgagttgtgtatgtttatgcataacgcggccacaagactggaaaatattgaaccccaccaggcgcaggaaatgccagttgtaattcccccatttcccgcagcgcaggcaaaactggccaatctttccccggtcacaccgctgatttatgtggcacatcaggatcaaaaaagtccgcctgctgtgatcacgcctccgcaatccccaaaactccaatggaaaggttttacgacaggtgtactgcttactctgtttctgggcagcgcagcgtgctggggctggcagtttgttgatcagcaggagagtattttaccgttgacggtttcggaggaggcgttaacaacacttgccgggcagtcatccctgtggctacaagactacggttttgcgctgagcaccaaagcgaaaccggaaaatatcgacaagtttaagatgcagtggcaacagcaaatcgtcagcaatgcattgccagttgaaaagctgtctggctggcatcagggaatggaaggactggaggatctgacccggcgtcttaatgagcttgatgaacgcaaaggtaaatatcttaccggatcggaattgaaatctatggtgtttaccattacccagaattttgcacgaacggagcctgttgaagaacaactctaccagcttagtaagatgacttccgggacaccggaactggccacttcactatcgcgtactgatatgcaccttaagcagttgcttaaccgctatatgctcatcaaacagcatgctgaaaagcaataataatcgttacttcagtgtccacgccgttcatccttgatgaacggcgcatctctttctcacatcaaacaatatcatccaccacgccgccgtccacgcgcagtgcagcacctgatgtcgctgacgcctgggtcgaacagacatagaccaccatattggcgacctcctcgaccgtggcggcgcgctggatcactgaactcgggcggttcgccatcacgaactctgtcgccagtgtttccagagatttgccggtgcgttccatgtcatctttcatcatggcggcgaagccgtctgacatggtcggacccggcagcacgctgttgaccgttacgccgctaccggcgacaaattttgccagtccgcgggcaagggaaagctgcgcggttttggtcacgccatagtggatcatgtccgacgggatattgagcgccgattcagaggagataaacaccacccgtccccagcgtttttgcaccatgccaggcaataatgcacgggcgaggcggacgccggacataacgttggtctgccagtagttttcccaggtttcgtcgtcggtggagtagaaatcctgcgggccataaatcccggcattgtttaccagaatatccacgccggaagccgcccgcagcaccgattccactccttccggcgtactgagatcggcaatggccgcacgcaccgccacgcccggcaccacctgctggagatgctgaataccctgatttaccgaactttcgctgcggccattcacgatcacttccgcaccgctctctgccaggccgcgggcgatagcaaagccaatcccgcccgttgaggcggtcaccagcgcgagttttcccgttaaatcgattttcatggactgctcccggtcattattgatgattcttcagaccgttaagcgtagcagttgcgtggcgcaagatgagttatccctagccaggcaaccggcttttaggacggccaggccccagcaggatcgccagcttgctgccgcctttggtggtctccatccagatcttacagacgctggtgagcggcacagagagcagcattcccaccgggccgagcagccatccccagatcagtaaggataaaaataccaccatagtcgacatgcccagacggtggcccatcatgcgcggctccaccatattccccagcaccatgtgcacgaccaggaagaggatccccaccatcataaactcgtaaaagccgttgaacaggaaggcctggatcatcggcgggatggccgagatcaccgagccgatgttaggcacatagttaagtaaaaatgccagcacgccccacatcagcgcaaactggacgcctaacagcatgagacccagccagatgatggccccggtccacaggctgatcagcgttttcagcgccaggtagtgcgacacaccttttaaggcgcggtgcaatccggcgatatggatctgcggattgttcagcgcaaagcgcagtttgtacggcagatggcgcacttcaaacagcataaacaccacggtcatcaccagcagcacaatgctcgccatagcgttcgacaggccggtcatcagcagggtggcaaaggccatcattttgtcggagtccatgcgctgtaacatgcgctccggcgacatgtgcagatgcaggaacggcatcatgtcctgtaactgcagaaccttacgcgttaattccttattgtatttaggcagcatggtgatgaattcattaaatgacgccgccagcacgccaaacagcgcggtcagcacgatcatcatgacaaccaccacaatggtgatcgcgactggtcgcttcacgccgcgacgcaaaaaccaggtcaccagcggattaagcacgatggcgaaaaacaacgccattaataactgaacaataatgtcggcggcggcatggatgcccgccagaataataaccagagcggctaatttcaggaggatatgcaagcccgctttatcgggctggggggtgatcatagtgaattccttttttcgctgtgcccgctaagtgtagtgcgttagcggggcttcgtatgacgtgcattatctgaatctgctgctgattttcagccgtcatcatgataatagtgaaacactgttgtaaaaaatgtggtgagttccatgcctgaacccgttgccgaaccggcgctgaacggattgcgcctcaacctgcgcattatctctgtcgttatttttaacttcgccagttatctgactatcggcctgccgctggcggtattgcccggctatgtccatgatgtgatgggatttagcgccttctgggcgggactggtgatcagcctgcaatattttgccaccctggtgagtcgtcctcatgccgggcgttacgccgatctgttcggcccgaaaaagattgtcgtcttcggtctgtgcggctgcgtgctgagcggcctgttttatctgctggcggggctgagcgccgccacgccggtggtctgtttattgctgctgtgcctgggccgggtgatcctcggcatcgggcagagttttgccgggaccggggctacgctgtggggcgtcggcgtggtgggatcgctgcatatcggaaaagtgatttcgtggaacggtattgcgtcttacggggcgatggcgattggcgcgccgctgggggtgctctgctaccactacaccgggctgacggggctggcggccattatcatggcggtggcggtaacggcgctactgtttgccctgagccgtccggcggtgaaggtcagcaaaggcaagccgctgccgtttcgcgccgtgctggggcgggtctggctgtacggcatggcgctggcgctcggctctgccggttttggcgtcatcgccacctttatcaccctgttttacgacgcccgtggctgggatggcgcggccttcgccttaacgctgttcagctgtgcctttgtcggcacacggctgtttttccccaataccgttaaccgcgtcggcgggctgaacgtggcgatggtctgtttcgtggtggaaaccctcggcctggtactggtggggctggctgtcgatccctggatggcaaaaatcggtgtactgctggcgggggcgggtttttcgctggtcttcccggcgctgggcgtggtggcagtgaaggccgtgccgcaacagaatcagggcgcggcgctggcgacctatacggtatttatggatctttcgctgggggtgacaggaccggcggccgggctgttgatggcatgggcgggcgtatcggtgatctatctggcggctgcggggctggtggcggtggcgctgttgctggcatggcggttaaaaaaacggcctcctgtggagaccgttgtttaactatgcgtgtccggcagagacttatttcagcacgatggtgttgataatgttctcagctgccgtttgcgcctgctgctggttttcggccggcagcgtgacctgaatggtcagcaatttgttatccactttacccagcaccacggaagaccaggcggtctggcctttggcagagataatgctgtcgagctgctgcattttctggcctttcacgtcgatggatttgttggtcaccacctgcagctgcggatcgcggctgcgctgctgatcttccagacgtttggtcagcacggacagctcttcgttgctgttatcgccgacaataacaatcaccgctttctggccggtcgcgtcagagtagacgtgcatgttgttagcctgggtgcccagtttgccgctctgatcggtcatgtctgcgggcagcgagaaactcagcttgccgtccagcagcgttactggctgaccggtcgcattggcttccgccgacgcagcctgcgccggagtcgctttatcattgttgtcacaggccgccagccccattaccagcaggccaataccgacatatttaaccagattgcgcattgacttcttcctttcgataaacggccataacggctcattcgtccatcttatcacaagttatcaggcgtacctttaactggcctgcaacgccggaatttcagatttatctgccagtcttttcaggcacatattaagcagtacgccgtacatcggcaggaagaagaccaggctgataagcaccttaaagctgtagtcaacgagcgcgatttccatccagtgttgcgccataaacgcatccggactgcgccagaaggcgataaagaagaaggcgatggtatcgctggcgttaccgaagatggtggaaaccgtcggcgcaagccaccagtggcggctctggcgcaggcggttaaagacgcgtacgtcgaggatctgccccagcgtataggccataaagctggcggcggcgatacgggcgacaaacaggttgaaatgcgccagcgcgccgaatccctgccagctacccatataaaacagcgacgaaatgatatacgacaccaccagcgccgggatcatcacggcaaagataatgcgtcgggccagcggcgcgccaaaaatacgcacggtgagatcggtggcgaggaatataaacggaaagctgaacgcgccccaggtggtgtggaaaccaaaaatggtgattggcaactgcaccagatagttactggaggtgatcaccagtaaatggaatagcgataaccagaacaacgcttttacgcgctgggattgagagaactgcgacatattgtgacctttttagtggttggggttagggaacccaattaatgcaacgtaattttataaagccgccgcatcatactgctttgactcaccattgcaatggctaattttcacgcaatcgttaacctgacttgcgtcacaaaaatggcggcgtaaactaatgcggtttttgaccggatgagacaaccatgagcgatctgtttaccacacctgaccacacccttgatgccctggggctgcgttgcccggaacctgtcatgatggtgcgcaaaaccgtgcgcagcatgcaggcgggcgaaaccctgctgattattgccgacgatccggcgaccacgcgcgacatccccggtttctgccgttttatggagcatgaacttgtggcgcaggagacagaatcgctgccttatcgctatctgctgcgtaaaggcgactagccgctgaccgcaaaaagaacccctgttgtcacattgttaaacctccgtttcattattttagcgcttttgtgaaccgcttcacccctgcccgtcacaacccaggctaatttctaagcgtaaaaataaaacacagttttaccgctgaccctaccctggagctgacccgatgaaaacgaccctcaagccgttactggcttcgctgtgcctgtccaccgcgtcattactgtttgcccctgccgtgatggcgcaggtgatcaaagccgccgacgtgcatccgcagggctacccgaacgtggtggccgtgcagaacatgggcgaaaaactcaaacagcaaaccgatggcaaattagaaattaaagtcttccccggcggcgtattaggggatgaaaagcagatgattgaacaggcgcagatgggggcaatcgacatgatccgcgtctcgatggcgccggtcgccgctattctgccggacatcgaagttttcactctgccgtacgttttccgcgatgaagaccatatgcataaagtgatcgacggcgatatcggcaaaagcatcggcgaaaagctgactaacaacccgaaatcgcggctggtgtttcttggctggatggattccggcacccgtaacctgatcaccaagacgcccgtcaccacgcctgaagcgctgaaagggatgaagatccgcgtgcagggcagcccggtggcgctggcgaccctgaaagcaatgggcgcgaacgcggtggcgatgggggtaagtgaagtgtacagcggcatgcagaccggcgttatcgacggcgcggaaaacaatccaccaacctttgtggcccataactacctgccgatcgccaagaattacaccctgagcggtcactttattaccccggaaatgctgctctattccaaagtgaaatgggacaaactcagcgccgacgatcagcagaaaatcctcaccctcgcccgtgaagcccaggccgaacagcgcacgctgtggcaggcgtataacgccgacgcggtcgcgaaaatgaaagctggcggcgtgaaattccaggaaatcgacaaggcggtctttgtgaaggcgacagagccggtgcgcgcgcagtatggcgacaaacaccaggatctgatgaaagccatcgcggatgtgaagtaattctgctgcgccagccgtccgctggcgcataacgccttgtggaggacgtatgtccgaaatctacctgaagtggatggatcgcctgtacctgctcgccatgacagtggcggggatttccctgctggtgatgaccattgtcatccccatcggcattttctcgcgctacgtgcttaaccgcggcgaatcctggccggaaccggtcgccattatctgtatggtgacttttacctttatcggcgcagcggtgggctaccgtgccggatcgcacatcgccgtcaacatgctgaccgatcgtctgccgctggcgctgaaaaatgtctgtgcgcgggtggtggatctactgatgctgctcatctccagcctgatcttctggtacagctatttactgtgtgtggaactgtgggagcagccggtagcggaattcccggtgctgacctccggggagagttatctgccgctacctgttggttcggcgatcctgatcctgtttgtgattgagcggctgctgttcggttcccaggagaaccgtccggtagtgctgattggtaaccatggttaagaggtgagagatggatgcatttgtgttgttgttcaccctcgccattctgctggcgctggggatgccggtggcctttgccgtcggcctgagcgccgtcgcaggcgcgctgtggatcgatttaccccttgaggcgctgatgatccagatcaccagcggggtgaacaaatttaccctgctggcgataccgttcttcattctcgccggcgcgatcatggcggaagggggcattgctaaacggctggtgaattttgcctatatctttgtcggctttattcgcggcggcctgtcgctggtgaatatcgtcgcctccacctttttcggtgcgatttccggctcgtcagtggccgataccgcctcgatcggcagcgtgatgatcccggagatggaaaagaagggctatccgcgcgattatgcggcggcggtgaccgccagcggttcggtacaggccattcttatcccgcccagccacaactcggtgatctactctctggcggcaggcggcacggtgtccatcgccacgctgtttatcgccggtgtgctgccgggactgctgctgggcgtctgcctgatgatcatgtgccttggctttgcccataagcgcggctacccgaaaggcgacaggatcccgtttaagcaggcgttgaagattttctttgatgcgctgtgggggctgtttactgtcgtgatcatcctcggcggtattttgtcgggaatttttacggccaccgaatctgctgctgtggcctgcctgtgggcctttttcgtcaccatgtttatctaccgtgactacaagtggagcgaactgccgaagctgatgtgccgcacggtgaaaaccgtcactatcgtcatgatcctgataggctttgctgccgccttcggtgcggtgatgacctacatgcagctgccggaacgtattaccgcgttctttacgtcgctgtcagataacaaatacgtcatcctgatgtacctcaacgttatgctgctgctgatcggcacgctgatggatatggcgccgattatcctcatcctgacgccggtgctgttgccggttaccaacgcgctggggattgatccggtgcacttcggcatgatcatgatggttaacctggggatcggcctgatcacgccgccggtgggatcggtgctgtttgtcgccagcgccgtcagcaagcagaagatcgagtccgtcgtgcgcgcgatgctgccgttctacggcatgctgctgctggtgctgggaatggtgacttatatcccggcgatctcgctgtggttgccgcgattgctggggatgcagtagtccgctaccgcttacccaacaaccgcagcgcattcgccgtcaccagcacggtggcgcctgtgtcagccagcaccgccagccacaggccggtgatgccgagcagcgtggtgaccaggaaaatggctttcagacccagcgcgatcgcgatgttctgccggatattggcatgggtggcgcgggccagctggatcatctgcgccagcccggtcaggcggttgtgggtcagcgccgcatcggcggtttccagcgccacgtcggtgccgctgcccatggcgatgccgagggtggcggctttcatggccggtgcgtcattaatgccatcgcccaccattgccagcggcgactgccgatccagcgcggtcacggcggtcaccttatcggcgggcaataacccggcacggaattccagtcccagcgcgctggcaatggccgctgccgcgcggggattatcgccggtgagcatcacgccgctgatgccaagccgacgcagggcatttacggcttcaggggcgtcttcccgcagcgtatcgcgcagcgccagggtgccgcacagcccgccatcgcgcagcacggcgatcaccgtctggccctgcgcttcctgttcctgaatttgagtaagccagctttcgtccagcacaccggcaggcagtttatccggcgcgcagataaagatagatttccccgcgacccttgcctcaatacccctgccaggcagcgtacgctgatcttccgcctgcatcagcgtcagattgcgcgcctgcgcttcctctgtgatggcctgcgccagcggatgggtggatccctgttccacggcggcggcacaggccagcagttcatcttcacccatcccctgcgccgaaacgcccactacctgcggtttacccaccgtcagcgtgccggttttatcgaacgccacctgacgaatacggcccagctgttccagcgccgcgccgcctttgattagcgctccacgacgcgccgccgccgccagcccggaggtgatggcggccggggtggagatcaccagcgcgcacggacagccgatcagcagcagcgtcaggcccttgtagatccactcgtaccaggccgctcctgccagcaatggcggcagcacggccaccagcagcgccgccgccatgatgaccggcgtatagacgcggctgaagcgatcgataaagcgctcgatgggcgcgcggcgttcctcagcttcttcgatcagttgcagaatgcgatcaatggcgctttcgcccgggcgggaaatgacttccagcgtcaccagccggtcgacgctggtcgccccggcgggaactttttctcctgcgcggcgctcaacgggcaccgactcaccggttaacgcgctttcgtcaaagctggcgaaggcggcgagtagtcttgcatccgccggtaaacgcccgcccgctgccacttcaatcacatcgccggggcgcagactgtccggtgccacggattcacgcgccgagcccgtgagccgcgtggcgctttccggtttcagggccatcagcgccgtgacgccctggcgggcgcggctggctgcccagccttcaagccgctcgccgattaaaaacagcagcaataccatggccgcttcggcggtggcgccgataaacagcgcgccgatggccgccacgctcatcagcgtttcaatggcgaaccagctgccgctttttatcagccgcagcgcctggcgggcaacggggaacagaccgaccagcgtggtggcgataaacgccagctggccgaggggatgattaacctgctccagaccccagctgatggccatcatgaccgccagcgtcagcagcggcaggttctcccgcagggtggagacgggcgggagcggggcctgcgcatcgcgcagcgtataaccggcgcgctgtacggcggtttcaatctgcgcacggacatcgcgcccggcatcgacaatcagtttttcggtggcgaaggtgacctggacctgattcacgccctcaacctggcgcacggcggtttcgactttacgggcgcaggcggcgcagtccatcccggcgacctgccaggaaaaacggctgccctgcggatcgccggatagcgatgccggtgccggatcggcatggtcagcgcagcagtttttttcaggcgcaggcgttaacgggcgcagcggggcgcgggcaaactgcggcgtttttttgacgggcggcgtgagcatggcatcctccgggaatgataattttctcattacccggaggatacactctggagtcgactccagagtcaagcattataagtagagcgatcgcacgatgaggaaatgcccggcaaagtagcaggcggcagagatggcgttgtcggcgtggaagcggcggcggtagtgactgcccagccagacgatattccccagcagcaacagcgcggcacccacaaaggcggacagggccggggccgtcggacggaagaaccacagctcgcccgccagccataccatcaccagcgtcatggcgataaaggtacagatcggccagcgcagctcctccagtcgcgtccagatcaccgcgatcaacagcgcgccaatgaccagcagcgccagcggcagcggccagaaaaaggacaacgtcatctgaccggcgaagtagatggtgtagagcagatgggcgaggaaatacgcgcctatggcgtacagcagacgctggcgcggcagcagcgtcagcgcatcaccgatcaacgaggcgcacagccccgccagcaccagatagctgatggcatcaaacatcggcgcctgccaggcaagcagcaacagcagtaataaagtgacaggtttaaatacccagcgttgccatgccggcccgcgatacgacgcgtccacatacaaccatgcggaaaaacatacagcgataaacgaccaaagcatcttaattccttgaattcgttattgtcgcgtgggcgttgcgcccacagccctgtcttcagtgtagtggtcgcgcaacgcagatggcaacgccccttcagcctgcggggagactttccgcattttctgaggcatccggtgaggattattttttgttttgcagcgctttcagacgtttttgccacaccagcagctcaaagacgccgaacagaaaaacgcgccactgttccgccgccgtcatctgtgggccatttttgggcagcgcggttttcagcatcaccatttgcaacgcatgcataaaagcggtgaataccagcgcgacgttgacgaaaatattcagcggccgcgggaaagggtggatgaggttgaggataagaaacgcccatacccccagcatcagtaaacgtcccagattaatcagcatgttgctctccttgtacggtgcggtgatacagacgataggccacctgaccggccactttctcgcgatgcagatcccagtgcacaggtacctgcggcagcccgttttccacttcgctttcgacataaatcagcgcgtcgtccgccagccagccgttcacttccagcaggcgtaaggtctcgtcgagcagccctttgcgaaacggcggatcgacaaaaacaatatcatggggggtaccggtctgattcaggaatgtcagggtgttggtgttgaccacgttggcgttagcggctttcagcgtcgccagattttgctgtaactgttgcgccacgctgcgctccatttcaatgagcgtggaggcaccggcgtagcgtgacagcgcttccagacccagcgcgccgctgcccgcaaagcagtcgaggcaacgggcattgaccatcgacggggcaagccagttaaacagggtttcgcgcacgcggtccgtcgtcgggcgcagaccagggctgtcgggcaccggcagtttacggccacgccactgtccgccaataatacgaatctggccgctggcggcacggttgggttttttcatagtgaaagctctggtcacaaatttatcccgctattttaacggcgggaagcgtggggtggaaccttaatcctcaggcggtgccgtgttgcaaggaaagtggtagactaacgaaagacttatcattacatcttactcatttttcagccccctgtttgcgacaatgcgggctgcgccatgaataaaccgcgaggagtgtagtcgcaaatggcaaaagagaaaaaacgtggcctgttctcctggttaggctttggtcagaaagaggagccgcaggaagccgcgccagaacagaaaatggaatcccaggcggttgttgaagaacaaccccctgttgaagcacaagcccctgttgaggaacagacgcctgccgaaactgcgccccattcgcagatcgaatccgaggcctttgccgcggacgtcgtggacgtcacggaaaaggtgattgagcgcgaagcgcaaccggaaatcctcgctgaagaggcggttgttgaaccggaagcggtcatcgagccggaagcgatcgttgaacctgaagcgattgtcgagcctgaggtggcggtagagcacaaagaactgccggtgccggaagagatcgcaaccatcgaaccggagccggaagcgtggctgcctgaagaaggtaccgtcgttgccgcagacgagccagagccggagcctgaggcgatcgtcgagcaggaaaaaccgactaaagaaggtttctttgcgcgcttaaaacgcagcctggtgaaaaccaaagaaaatctcggttccggatttatcagtctgttccgcggcaaaaaaatcgatgatgatctgtttgaagagctggaagagcaactgctgattgccgatgtcggcgtggaaaccacccgtaaaatcattaccaatctgacggaaggggccagccgcaaacagctgcgcgatgcggaatcgctgtacggtctgctgaaagatgaaatgagcgatatcctcgcaaaagtcgacgaaccgcttaatattgaaggcaaaatgccatttgttattctgatggttggcgttaacggcgtgggtaaaaccaccaccatcggcaagctggcgcgtcagtttgagcagcagggcaaatcggtgatgctggcggcaggggataccttccgtgcggcagcggtggaacagcttcaggtatggggccagcgtaacaacattccggtgatcgcccagcacaccggtgcggactccgcctcggtgattttcgatgccatccaggcggcgaaatcccgtaaggtggatgtgctgatcgccgataccgcagggcgcttgcagaataaagcgcacctgatggaagagctgaagaaaattgtccgcgtgatgaaaaagctcgatgtcgacgcgccgcatgaagtgatgctgaccatcgacgccagcaccggacaaaatgcggtaagccaggccagactgttccacgaagccgtcgggctgaccgggatcaccctgaccaaacttgatggtaccgccaaaggcggcgtgatcttctcggtagccgaccagttcggtattccgatccgctatatcggtaccggcgaacgtattgaagacttacgtccgtttaatgcgggcgattttatagaggcactttttgcccgagaggattaacaatgattcgctttgaacatgtcagcaaggcttatctcggcgggagacaggcgttgcagggggtgacattccacctgcaaccgggcgagatggcgtttctgaccggccactccggcgcaggtaaaagtacgctgttaaagctgatctgcggtatcgagcggccaagcgccgggaaaatctggttttccgggcatgagatcagccgtctgaaaaaccgcgaagtgccgtttctgcgtcggcagatcggcatgatttttcaggatcaccatctgttaatggaccgtacggtctttgacaacgtggcgatcccgctgattatcgccggggccagcggtgaagacattcgtcgtcgcgtatcggcggcgctggataaagtcgggctgctcgacaaagcgaaaaactttcccattcagctttccggcggtgaacagcagcgcgtgggcattgcccgtgcggtagtgaacaaacctgcggtgctgctggcggacgaaccgaccggtaacctggacgacgcgctgtcggaagggattttgcgtctgtttgaagaattcaaccgcgttggggtaacggtactgatggccacgcacgacatgagtctgattgcgcgccgctcgtaccgcatgctgagtctgagcgacggtcatttgcatggaggcctgacgggtgaataaacgcgacgcagtcaatcaaatccgccagttcggcaataaactggaccgcttccgtaaaccgggacagggcagcggcggcaaccgtggcggttccggccgcagcaaaacgccgccgaagcctggctcgcgcaagaccaacgtttttaatgaacagatgcgctacgcctggcagggcgcggtgcaggatctgaaaagcaaaccgctggcgactctgctgacggtgatggtgatcgccatctccctgacgctgccgagcgtctgctatatggtgtacaaaaacgttcaccaggcctcatcgcagtattacccgtcgccgcaaattaccgtctacttcgataagacactggacgacggcgccgcgcagcaggtggtcgggcagttgcaggcggaacagggcgtcgagaaggtgaactacctgtcgcgggaagacgcgctgggcgagttccgcaactggtcaggctttggcggcgcgctggatatgctggaagaaaacccactgcccgctgtggcggtcgtggtgccgaaaatcgacttccagaataccgaatcgctgaataccctgcgcgaccgtatcacccgcattaacggcattgatgaagtgcggatggacgacagctggtttgcgcgtctggctgcgctcaccgggctggtgggccgcgtgtctgtgatgatcggcattctgatggtggcggcggtatttctcgtcatcggtaacagcgtgcgtctgagcattttctcccgtcgcgacagcatcaacgtgcagaaactgatcggcgcaacggatggctttattctacgtccgttcctctacggcggggcgctgctcggctttagcggggcattcctgtcgctcattctgtcggagatcctggtgatgcggctgtcatcggcggtgacggaagtggcgaagattttcggcacccagtttgagctaagcggcctctcatttgacgagtgtttattactgctgctggtgtgctcaatgattggctggctggccgcgtggctggcaacggtgcaacatttacgtcactttacccccgactaaaaattctctgatatactctttccctgctgcatcggatgtctgttagcagggaaagagtccctgatctctcttttctcctgcttagcctttatcatagtaatgtcacattttgtgcgtaatctattcacaacgttgcatggaacttgtggataaaatcactgtctgataaaagtgtggatgatattctcgctgctcataagcgctggcatgtttgttgcctgaaggggacaagccgccgccagtaagaagtacattgagaggatttgaatgaccaaagaaatgcaaactttagctttagcccctgttggtaacctggaatcttatatccgggctgcgaacgcatggccgatgttgacggctgatgaagagcgggagcttgctgaaaagctgcattaccagggttcactggaagcagctaaaacgctgatcctgtcgcacctgcgctttgttgttcatattgctcgtaactactcgggctatggccttccgcaggcagacctgattcaggaaggtaatatcggcctgatgaaagctgtgcgccgcttcaatccggaagtgggtgtgcgtctggtctctttcgccgtgcactggatcaaagccgaaattcacgaatacgtgctgcgtaactggcgtattgtgaaggtcgccaccactaaagcgcagcgtaagctgttctttaacctgcgtaaaaccaagcagcgtctgggctggtttaatcaggacgaagtggaaatggtcgcccgcgagctgggtgtttccagtaaagacgtgcgtgagatggaatcccgtatggccgcccaggacatgacctttgacatgtcgtcggacgatgaatccgacagccagccaatggcgccggtactctatctccaggataaaacctctaactttgccgacggcattgaagacgataactgggaagagcaggccgcgaacaaactgaccgatgcgatgcagggtctcgacgagcgtagccaggcgatcattcgcgcccgctggctggacgaagacaacaagtctacattgcaggaactggccgaccgctatggtgtttccgctgagcgtgtgcgccagctggaaaagaacgccatgaaaaaactgcgtatcgccatcgaagcctgatctccgcaaaccgctttttgtggtttgacgtcaaagacccctggatgaaagtccgggggttttgtttttttacgcctgctctggcgattttttaccctgtggcaaacacttacagatgcgcatttcgtgtttatggcatctcagggggtcagggtgaaaaataacgaactcaatgaaagacgtttacaggccacgccgcgcggcattggcgtgatgtgtaatttttatgcggataaagccgaaaacgccacgctgtgggacgtggaaggcaacgaggtgatcgacttcgccgcgggcattgccgtgctcaataccgggcatcgtcatccgaaagtgatggccgccgtggaaaaacagctgcacgcctttacgcacacggcgtatcaaatcgtgccctatgagagttacgtcgcgctggcggaaaaaatcaacgcgcgcgtgccagtcgcagggcctgccaaaaccgcctttttctcgaccggcgctgaagcggtggaaaacgcggtgaaaatcgcccgcgcgtacactcgcaggccgggtcttatcacctttggcggcggctttcatggccgcacctatatgacgatggcgatgaccggcaaagtcgcgccctacaaaatcggcttcggtcccttccccggatcggtgtttcacgcgcagtaccctaatacgctgcatggcgtgagtacagccgatgcgctgaacagccttgagcgtattttcaaagcagacatcgcgccggatcaggtggcggccatcgtgctggagccggtgcagggtgagggcggatttgtcatcgcaccggatgatttcatgcagggactgcgcgccctgtgtgatacccacggcattctcttgattgccgacgaagtgcagaccggctttgcccgtaccggcaaactttttgccatggagcatttcagcgtcaaacccgatctcatcaccatggcgaaaagcctcgccggtgggctgccgctgtcggcggtagcgggacgcgcagaggtgatggacgcgcctgcgccgggcgggctgggcggcacctatgccggaaacccgctggcagtggcggcagccctggcggtgctggaggtgatcgacgaagaaaacctgtgccagcgcgcggcccaactgggacagcatctggtggaagtgctggaaaaagccagagcggagtgcccgcagattgccgggatccgcgcgctgggttccatggtggcggtggagttcgccgatccgcacagcggcgagccgtcgccggaatttacccgtcaggtacaggcgcgggcgctggaggccggactgctgctgctcaactgcggcgtgtacggcaacgtgatacgtttcctctatccgctgaccattccggaagcgcagttccggcaggcgctggatattattcacgcgtcgctaacccggtaaaaatgttgttacatattctgaaaaatggggtatgttttagcagagtatgctgctaaagcacgggcggcagaccaataatcgaaataaagtgctgaacaacaacatcacaacgaatgtaataaccacaataatggggattctcaggatgaaaatgaagggtaaagcgttactggcaggatgtatcgcgctggcaatgagcaacgtcgcattcgcgaaagacattaaagttgcggtggtgggcgcgatgtccggcccggtagcgcagtatggcgaccaggaatttaccggcgcgaaacaggcgatcgaagacatcaacgccaaaggcggtatcaaaggcgacaagctggttgcggtacagtacgacgatgcctgtgacccgaaacaagccgttgccgttgccaacaaagtggttaacgacggtatcaaatacgtgatcggccacctgtgttcctcctctacccagccagcgtctgacatttatgaagacgaaggcattctgatgatcacgccagctgccaccgcgccggaactgaccgcacgcggctataacatgctgctgcgcaccaccggtctggactctgaccagggcccgacggctgcaaaatacattctggaaaaagtgaagccgcagcgtatcgccgtgatccatgacaaacagcaatacggtgaaggcctggcgcgtgccgtgcaggaaaacctgaagaaaggcaacgcgaacgtggtgttcttcgacggtctgactgcgggtgagaaagacttctccacgctggtggcgcgtctgaagaaagagaatatcgacttcgtttactacggtggctaccacccggaaatggggcagatcctgcgccaggcgcgtgctgccggtctgaaaacccagtttatgggcccggaaggcgtggcgaacgtctccctgtctaacattgccggtgaatctgccgaaggtatgctggttaccaagccgaagaactacgatcagctgccggtgaacaaacctattgttgacgcgatcaaagcgaagaaacaggatccgagcggtgcattcgtatggaccacctacgcggcgctgcaatccctgaaagcggggctggagcattcagaagatccggcagagatcgccaaatacctgaaagccaactctgtggaaaccgtaatggggccactgagctgggatgagaagggcgacctgaaagggtttgagttcggcgtgttcacctggcatgcgaacggtacggcgactgacgcgaaataagaaaaccgtcaaataccatccttcctgtaaacccgctgcggcgggttttttcatttgattgcgttacgcgacaaaatgtcgcaaacttgagatgtttaaaaaaaccattgttccaaaacgatggccacaaaactggagtaccgatatggcaattagcatccggctggatgatgattttgttgaaaaagtgaaggttcatgccgacgcgcagagccgtagcgtgccgaagcaaattgaacactgggcaaaaataggacgcattgcggaagcgaatcctgaaatgtcctgggcgcttattaacgaaatcctgctggctaaatcagaaatcgacaacggacacgtcaccaaatatgtgcgcaaaaaagacaggacctgaaattgaggtatatcagtcacgtcgttttgaaaagaaatttgccgcgctgactgaacaggaacagaaagatgtcgatgagcaaatcgaactgatcctggacgatccagaacttggcgaacgcaagaaaggggatctcagtttcctgcgcgtacataagttcagaatgaataaccagctgtacctgttaggttacagctggattgaaggaaagctggagctgtatcttctaagcattggctcccacgaaaatttttatgacgagcagaaacgtcatcgcaaagccgatctgaagctcatcgtatagtctgcttccccttgcgccggtgaggggatttaccgcttctgccagccgtccgcgcgggcgctgaaacctgccgactgcataaacgcatccatcaccgttttatcttcgaccgcaatatcagacatccaccagacgctgatctccgggtgtgcgcgcagcacttcctccagcaaatacttgcccacgccacggcggcgggtgacgtcgcgtacgcgcagcgaatccagcgctccgtctttgccgcttaaggtgacgcgcaccgcagccagcagacgatcgttaaaccgtgcggcatagatgcagtggctgtcgtcaaccgccagggagtccggggagtactccggccagattttgcctaaatcgatatgatcctgttcgctgaatgtgttcagacggatgatagtcagtttcatttactgcgggtccagatcgtcaagtgagggtgcagtgtactcaatttttgcgctcaggcgctttcactttttaaatccattcatcaggcgattacttctgactcagccgtcagagtagttttaaacgtcagggatcgaaaaataagcagtattttaacctgacaggcagtgatttattccacgctttgtaccattattttatgctggcaagggcactttttttgtttatctctgaataaatacagaatattatctgttcttaatcgcctgaaaaatagggaatttagtgtggttttcagtaaaaaactacgctaaaccattaaaggcacaggtaaaaatagcattgtgcattaaatcgtcagcgttatttttaaccattaacaaacaaattttatacacaattattatgagccgccgcggggtcttccttcgccggtggccagacgtgtaaacacgacatcacgaatggggattttcaggtatgaacaggaacgcgaagacgttgatcgcggggatgatcgcactggcgatgtcgcaaaccgctattgctgccgatattaaggtagcggtggtcggggcgatgtccggtccggttgcccagtggggcgatatggaattcaacggtgcccgtcaggccatcaaagatattaacgccaaaggcggtatcaaaggcgacaagctggtcgcggtggaatatgacgacgcctgcgatccaaaacaagcggtggcggtggccaacaaaatcgttaatgacggtattcagtatgttatcggtcatctctgctcatcatccacccagcccgcgtcggacatttatgaagacgaaggcatcctgatgatttcgccgggcgccaccaatcccgaactgacacagcgcggctatcagcacattatgcgtaccgcaggcctggactcctcacaagggccgaccgccgcaaaatacattctggaaaaggtgaagccgcaacgcatcgccattattcatgacaagcagcaatacggcgaaggtctggcgcgctcggtgcaggacggcctgaaaaaaggcggcgcgaatgtggtcttctttgacggtattaccgccggtgagaaagatttctccgcgctgatcgcccgtctgcaaaaagaaaatatcgacttcgtgtattacggcggctactaccctgaaatggggcagatgctgcgccaggcgcgcgcaagcggtctgaaagtacagtttatgggaccggaaggcgtgggcaattcgtcgctgtcgaatatcgcgggcgaggcgggcgaaggcatgctggtgacgatgccaaaacgctatgaccaggatccggcaaacagcgctatcgtttccgcgctgaaagccgataaaaaagatccgtccggcccgtacgtatggatcacctatgccgctgtgcagtcgctggcgaccgcgctggaacgtaccggcagcgatgagccattagcgctggcaaaagatttaaaagcaaacggtgctaagaccgtgattgggccgctgaactgggatgagaaaggcgatctgaagggatttgaatttggcgtcttccagtggcacgccgacggttcatcctcggtagccagataacactcccaccgcccggcactgtcgggcgggaataaaaaggtttccctatgtccgagcagtttctctacttcatgcagcagatgtttaacggcgttacgctgggaagcacctacgcgcttattgccatcggttacaccatggtttacggcattatcggcatgatcaacttcgcccacggcgaggtgtatatgatcggcagttatgtctcctttatgatcatcgccgcgctgatgatgatgggcatcgacagcagctggctgctggtggccgccggctttgtcggggcgattgtcatcgccagcgcctacggctggagtatcgaacgggtggcctatcgcccggtgcgcagctccaagcgcctgattgcgctgatctccgccatcgggatgtccatcttcctgcaaaactacgtcagcctgacggaagggtcgcgcgatgtggcgctgccaagcctgtttaacggccagtgggtggtgggcagcagtgaaaacttctccgcgtccattaccaccatgcaactggtgatctgggtggtgactttcgtcgccatgctggcgctgacgctctttattcgctactcccgcatgggccgcgcctgtcgcgcctgtgccgaagatctgaagatggcgagcctgctcggcatcaacaccgaccgcgtgatcgccctgacctttgtcatcggcgcggcgatggcggcggtggcgggcgtcctgctcggtcagttctacggcgtaatcaacccgtacatcggctttatggccgggatgaaagcctttacggcggcggtgctgggcggtatcggcagcattccgggcgcgatgatcggcggcctcattctgggcgtcgcggaatcgctctcttcggcgtacctgagcacggaatataaagatgtggtgtccttcgcgctgctgattggcgtgctgctggtgatgccgaccgggatcctcggccgtccggaggtagagaaagtatgaaaccgatgcattttgcgatggcgctgctgtcggcggcgatgttcttcgtactggctggcgtctttatgggcgtgcagctgcagctggacggcaccaaactggtggtcggacacgcggcggatatccgctggcagtgggtgtttgtcggcaccgcagtggtctttttcttccagctgctgcgtccggtattccagaaaagcatgaagggcatctccggcccgaagttcgtgctgccggccattgatggctccacggtaaaacagaaactgttcctgctggcgttgctggtgctggcagtggcctggccgtttatggtgtcgcgcggcacggtggatatcgccaccctgaccatgatttacatcattctcggtctggggctgaacgtggtggtggggctgtccggcctgctggtgctgggctacggcggcttctacgccattggcgcgtacaccttcgcgctgctcaaccactattacggcctcggcttctggacctgcctgccgctggcagggctggtatcggcggcggcaggtttcctgctcggcttcccggtgctgcgtctgcgcggcgactatctggcgattgtcaccctcggcttcggcgaaattgtgcgtattctgctgctcaacaacaccgaagtgaccggcgggccaaacggtatcagccagatcccaaaaccgacgctctttggtctggagttcagccgtacggcccgtgaaggcggctgggataccttcagcaacttcttcaacgtgaaatacgatccaagcgaccgcgtggtgttcctctacctggtggcgctgctgctggtggtgctgagcctgttcgtcattaaccgtctgctgcgtatgccgctgggccgcgcgtgggaagcgctgcgcgaagatgaaatcgcctgccgttctctgggcctgaatccgacccgcatcaagctgaccgcgttcaccatcagcgccgcctttgccggttttgccggtacgctgtttgctgcgcgtcagggctttgtcagcccggaatccttcacctttgcggaatccgcctttgtgctggcgattgtggtgctcggcggcatgggctcgcagttcgcggtgatcctggcggctatcctgctggtcgtctcccgtgaattaatgcgtgatttcaatgaatacagcatgttaatgctcggtggcctgatggtgctgatgatgatctggcgtccgcagggcctgctgcccatgacccgtccacagctgaaactgaaaaccggggaagccgcgaaaggagagcaggcatgagtcagcctttattgtccgttaatggcctgatgatgcgcttcggcggtctgctggcggtgaataacgtctcgctggatctgcatccgcaggaaattgtgtcgctgattgggccgaacggcgcgggtaaaaccacggtgttcaactgcctgactggcttttataagccgaccggcggcaccatcatgctgcgcgatcagcatctggaaggtctgccgggccagcagattgcccgtatgggcgtggtgcgcactttccagcacgtgcgcctgttccgcgaaatgacggtgatcgaaaacctgctggtggcgcagcatcagcagctgaaaaccggtctgttttccggcctgctgaaaaccccggccttccgtcgcgcgcagactgaagccttggatcgcgccgccacctggcttgatcgcattggtttgttagcacacgctaaccgccaggcgagtaacctggcgtacggcgatcaacgtcgtctggagatcgcccgctgcatggtgacgcagccggagatcctgatgctcgacgaacccgcggccggtctgaacccgaaagaaaccaaagagctggacgagctgattgtcgagctgcgtaatcatcacaacaccaccatcctgctgattgaacacgacatgaagctggtgatgggtatttccgaccgcatctacgtggtgaaccagggcacgccgctggccaacgggacgccggagcaaattcgtcataacccggatgttatccgtgcctatttaggtgaggcataagatggaaaaagtcatgttgtcctttgacaaagtaagtgcccactacggcaagattcaggcgctgcacgacgtgagcctgaatatcaggcagggggaaatcgtcaccctgattggggccaacggcgcgggtaaaaccacgctgctgggcacgctgtgcggcgatccgcgcgccaccagcgggcgtgtgaccttcgacgggaaagacattaccgactggcagaccgcgaaaatcatgcgggaagcggtggcaattgtgccggaagggcgtcgcgtcttctcccgcatgacggtggatgaaaacctggcgatgggcggtttctttgccgaccgcgagcagttccagacccgtattaagcgcgtctacgagctgtttccgcgtctgtatgagcgccgtattcagcgtgcgggcaccatgtccggcggggaacagcagatgctggcgattggccgcgcgctgatgagtcagccgcgtctgctgctgctggatgagccatcgctcggtcttgcgccgatcatcatccagcaaatcttcgacaccatcgaacagctgcgtcaggaagggatgaccattttcctggtcgagcagaacgccaaccaggcgctgaagctcgccgatcgcggctacgtgctggaaaacggtcacgtggtgctggaagataccggcgacgcgctgctggcgaacgaagcagtacgcagcgcctatctgggcggttaagttttatcaggcccggcaacctccgccgggcctacacattaccttcacctgatcatcatctgcctatcatctccctgacccctgactgtcaccgttttgtaattaaaaggttatttttctgtcattcgcgcgtgtcatgttacctcgcgagcataaaacgcgtgttttcgcgcatccggcacaacaagagagataaccgaatgacttcgttacgacatacagctttaggactggcgataagcctggcatttgcaggtcaggcgatggcagtcaccactattccgttctggcactccatggaaggtcagttaggtaaagaagttgaatccctggcgcaacgttttaatgacacccatccggattacaaaattgtgccggtgtacaaaggcaactacgagcagagcctgagcgcgggtatcgcggctttccgtaccggtaatgcgccagctttgttacaggtgtatgaagtaggcaccgccactatgatggcgtcgaaagccattaaaccggtgtacgaagtgttcagcgatgcgggcatcaagtttgatgaaacgcagttcgtgccgacggttgccggttactacaccgattcaaaaaccgggcacctgctgtcccagccgttcaacagctccacgccggtgctgtattacaacaaagacgcctttaagaaagccggtttagatccggagcagccgccgaaaacctggcaggacctggccgcctataccgcaaaactgaaagcggcaggcatgaaatgtggttacgccagcggctggcagggctggatccagattgaaaatttcagcgcctggcatggtctgccggtcgccagcaaaaacaacggctttgacggcaccgacgcggtactggaattcaacaagccggagcaggtgaaacacatcgccctgctggccgatctgaacaagaaaggcgacttcagctactttggccgcaaggatgagtccaccgagaagttctataacggcgactgcgctattaccactgcctcttccggttcgctggcggatatccgtcactacgccaaattcaactacggtgtcggcatgatgccgtatgacgccgatgtgaaaggcgcgccgcaaaacgccattatcggcggggccagcctgtgggtgatgcagggtaaagacaagccgacttacaccggcgtggcgcagttcctggaattcctggcgaagcctgaaaatgcggctgaatggcaccagaaaaccggctatctgccgatcaccaccgctgcctataacctgacgcgcgagcagggcttctacgataaaaacccgggcgcggataccgcaacccgtcagatgctgaacaagccgccgttgccgttcaccaaaggcctgcgtctgggcaacatgccgcagatccgcaccattgtggatgaagagctggaatcagtgtggaccggcaagaaaaccccgcagcaggcgctggattccgccgttgagcgcggtaatcagctgctgcgccgcttcgagcagtcgacgaagtcttaatgttttcatgccggatggcgctgcgcttatccggcctacaagtggcatttagcctgtaggccgggtaaggcgaagccgccacccggcgctgttcaggaatccaatccccatgtcatcatcccgtccggtattccgttcgcgctggctgccttatgcgctggtcgccccgcagctgattatcaccatcattttctttatctggcctgcgggcgaagcgctgtggtactcggtacagagcgtcgatcccttcgggctgtccagccagttcgtcggcatggacaacttcgtcgccctgtttcatgacagttattacctcgactccttctggaccaccatcaagttcagcggcatggtcaccttctggggattgctgagttcattattcttcgccgcgctggtggactatgtgatccgcgccagccgcctgtaccagacgctgatgctgctgccttatgccgtcgcgccggccatcgccgccgtgctgtggatcttcttattcaaccctggccgcgggctgatcacccatgcgctggaagcggtgggatacaactggaaccatgcgcagaacagcggacaggcgatgttccttgtggtgttcgcctccatctggaagcagatcagctacaactttctgttctttttcgccgcgctgcaatcaatcccccgctcgctggtagaggctgccgccattgacggcgccgggccggtgcgtcgcttcttccagctgtcgttaccgctgattgcgccggtgagctttttcctgctggtggtgaatctggtatatgccttcttcgataccttcccggtgatcgacgccgcgacggcgggcgggccggtacaggccaccacgacgctgatctacaaaatttaccgcgaaggcttcgccggactggatctctcggcctctgccgcgcaatcggtggtgctgatgctgctggtcatcgggctgaccgtcgtgcagttccgctatgtggaaagtaaggtgcgctaccaatgatcgagaaccgccgcgggctgacgatcttcagccatgtcatgttgatcctcgggatcgccgccattctgtttccgctgtacgtggcctttgtcgccgccacgctgaataaccagcaggtgtttgaaacgccgatgacgctgatccccggcacacatctgctggaaaatatccgcaccatctggcgggaaggcgtgggggcgaacagcgcgcccttcggactgatgctgctgaacagctttatcatggcgttcagcattacggtcggcaaaatcgtggtgtcgatgctctccgctttcgccatcgtctggttccgctttcccctgcgtaacctgttcttctggatgatttttatcaccctgatgctgcccgttgaagtgcgtatttttccgacggtggaagtgatcgcccggctggatatgctcgacagctataccggcctgacgctgccgctgatggcctcggcaaccgccaccttcctgtttcgccagttctttatgacgctgcccgacgagctgatcgaagccgcgcgcattgatggcgcatccccgatgcgctttttccgcgacatcgtgctgccgctgtcgaaaaccaatctggcggcgctgtttgtcatcacctttatctatggctggaaccagtatctgtggccgctgctgattgtcagcgatgtgaacctcggcacagcggtggcgggcatcaaggggatgatcgccacgggagagggcaccacgcagtggaaccacgttatggccgcgatgttgctgacgctcatcccgccggtcgtcattgttttagccatgcagcgtgcctttgtgcgtggtttagttgatagcgagaaataagatggcaggtctgaaattacaggcagtaaccaaaagctgggataacggcaaaacgcagattattcagccgctgacgctggacgtgtcggacggtgaatttattgtcatggtcgggccgtccggctgtggtaaatccacgctgctgcgtatggtggcgggtctggagcgggtgtccagcggcgacgtgtggatcgatcgccagcgcgtgaccgagctggagcctgtcgatcgcggtattgccatggtgttccagaactacgcgctttatccgcacatgagcgtggaagaaaacatggcctggggcctgaaaattcgcggcatgggcaaagcgcacatcgccgagcgggtaaaggacgccgcgcgtattctggagctggacggcctgctcaaacgccgtccgcgcgaactgtccggcgggcagcgtcagcgtgtggcgatgggccgcgccattgtgcgcgatccggcggtcttcctgtttgatgaaccgctctccaacctcgatgccaaactgcgcgtgcagatgcgccttgagctgcaacagctgcaccgtcgcctgaaaaccacctcactgtacgtcacccacgatcaggtggaagccatgacgctggcccagcgcgtgatggtgatgaacaaaggcgtggcggagcaaatcggcacgccggtagaagtgtacgagaagcccgccagccgctttgtggcgagctttatcggcagcccggcgatgaacctgctggaagggcgcatcagcaccagcggcacccattttgatctcgacagcggcatgtcgctgccgattaactgggtttaccgtggctataccggtcgcaaaatgacgctgggtatccgcccggaacatattacgctaagctcacaatccgcaggcgggatcccgctggtgatggacacgctggaaatgctcggcgctgacaacctggcccacgggcgctggggcgaacagaaaatggtggtccgtctgccgcatcatgaacgtcctgcacctggcagcacgctgtggctgcatttcgcggaaaaccatctgcaccttttcgacggtgacacaggacaacgagtatgagcaactggccctatccccacattgtcgcgcatcgcggcggcggcaaactggccccggaaaataccctggccgccattgataccggcgcgcgcttcggccacaccatgattgaatttgacgtgaaattgtcgcaggacgggcagatcttcctgctgcatgacgacaatcttgagcgcaccagcaacggctggggcgtggcgggcaggctgccgtggagcgatctgttacaggtagacgcgggaagctggttcagccgcgattttacaggcgaacccctgccgttgctgtcgcaggtggcgcagcgctgccgcgagcacggcatgatggcgaacattgagatcaaaccgaccaccggcaccggcccgctgaccggcaaaaccgtggcgctggcggcacgtgaactctgggcggacatgacgccgccgctgttatcatcatttgatattgatgcgctggaagcggcgcaagaggccgtgcctgagctgccgcgcgggttgctgctggatgagtggcgggatgactggcgggcgctgacgacacagcttggttgcgtctccatccatctgaatcatcgcctgctggatgaagcccgcattgccgcgctgaaagacgccgggctgcgtatcctggtttacaccgtcaacaaacccgggcgcgccgctgaactgctgcgcgccggggtggattcaatctgtaccgacagcatcgacattatcggcccgaactttcagccttaaggactgatggttttcagcgggatattcggctgcggcgtgctgccggtgttctgattcagcatgctgccgttcgtctgctgcggcagcatgtgctgctgcgtattcagcgaggcatcgctgttatttagcatcccgccattgctgtttggcagcggctgctggcgcggcagcgtcggttcgcccggctgggactggatgatccgctgcgagttgttattaatctgcgattccagatgctgctgctgaatacgggtctgcgactgtaactgctgattcagcatgcctttttgctgtgactgctggttaagcatctgcgtctgcatccgctgctgcgacgggatctgatagtccggcagattcgggttattcatggtattaagcggctgtgcgaaagcgccaaacggcaataatgccgccagaatcaggtagggtttcatcatcatctcctctcatggggaatagcttaagtttacttgctctccggcaaaacgatgattttttaagagtagtgaaccaggcttaagcggggcctgttgctcatatctctggagaaccgcgatgatgaaacagaatgttgtgcgttgggtggccgtcgccgctctgatggcagggggatgttttggcgtggctgctgcacctccgccgccaccgccgccggtgtcatacggcgtggaagcagatgtcttccatccggtgcaggcgaaagagggcatggtggcgtctgtggatgcggcagcgacccgcgtcggcgtcgatattcttaagcagggcggtaacgccgtggatgccgccgtggcggtaggttatgcgctggcggttacccatccgcaggcgggcaatctgggcggcggcgggtttatgctgctgcgtaccaaagacgggcagaccaccgccatcgacttccgcgaaatggcgccggcccaggcatcgcgcgatatgttcttagacgatcagggtaatcccgacagtaaaaaatcccttacctcacatttagcgaccggcacgccgggcacggtggcgggcttctcgctggcgctggaaaaatacggcacgctgccgctgaacaaagtggtgcagcctgccatcaaactcgccaggcagggctttaccgttaacgacgcgctggcggaagatctgaaaacctacggcagcgaagtgttgcccaactatgaaaatagtaaagcaatcttctggaaaaacggtgagccgctgaaaaaaggcgacaaactggtgcaggctaatctggctaaaagcctggagatgatcgccgaaaaaggcccggaagccttctacaaaggcgcgattgccgatcagatcgcccaggagatgagtaaaaacggcggcctgatcaccaaagaggatctggctgcctataaagccgttgagcgcacgcccattagcggcacctatcgcggttatgaggtgttctccatgccgccgccgtcctccggcgggatccacatcgtgcagatcctgaatatcctcgaaaacttcgatctggcgaaatatggctttggcagcgccgatgccatgcaggtgatggcagaagcggaaaaatatgcttatgccgatcgctcggaatatttaggcgacccggattttgtgaaggtgccgtggcaggcgctgaccaataaggaatatgccaaatccatcgcccagcagatcgatgtgacaaaggcgaagccgtcgagccagatccgcccgggcaagctcgcgccttacgaaagtaatcagaccacgcatttctcggtagtggataaagacgggaacgccgtctcagtcacttacaccctgaacactacgttcggaacgggcattgtggcagggaataccggtatcctgctgaataacgaaatggatgatttctcggctaaaccgggcgtacctaacgtttacgggctggtgggcggcgatgcgaacgccgtggggccgggcaaacgtccactgtcgtcgatgtcgcccactatcgtggtaaaagacggtaaaacctggctggtcaccggcagtccgggaggcagccgtattatcacgaccgtgctgcaaatggtggtcaacagcattgattttgggatgaacgtcgccgaagcaaccaacgcgccgcgcttccatcatcagtggttgccggacgagctgcgcgtggaaaaaggcttcagcccggatacgctgaaactgctggaacaaaaagggcagaaagtcgccgtgaaagaggcgatgggcagtacgcagagcattatgatcgcccctgacggtatgcgatacggcgcatcagatccgcgctcggtggatgatctgacggcggggtattaacttttatgcccctcaccccggccctctcccgtggggagagggggagtatggcatcggtttatgccctctcccctggggagaggggcagggtgaggggcgctatttcatccgcgccataaacagcgcatcgatatattcgccgttacgcagcgcatattttttgccggtgccttcggtttcaaatccgtatttacgatacagcgccagcgcaggcgcattatcgacaaagaccgtcaattcgatacgttcaatacgcagccagttgtcgcacaggttgaccatctcacgcagtaacgcgctgccgacgccgcggttgcggaaatcgggcgatacgctgatgccaaaggtcgccacgtgactgcggcgcgggttctgctcgacgctcagcgccagatggcctgtaacaataccgtcaatacaggccaccagatggcgacgacccggctgtggttttagtcgctcctgccacatttccatagaaggatgcggaatttgtagcgtgtcgtgatacacctccggctgggcattcaactggcgtaatgcttcggcgtcgtccggttgtacgtggcggatcacaatatcgctcattcctttttctcctgtgggtgaattatcccctttaacatcaggtactccgcaatgtgcgtcaactgccatttttgtgactaaaccgggaagttactcaaaccaggggccgaaataatccgggtaatgttggagatggcgcgaaagagcggcgcattttcatcgagatcggtaacaatcaaatcaacgtcattcaaatcagaggctttatgcaaatgcgttaaaccaaactttgtctggtcagcaacgacgataacctgctgtgcctgacgcattatcgctttttttgtataagcatcttcttcatttggcagggtgatccctgaattcagatcgatgccctcggtgccaataaatacaatatcaaaattaaattgcttaatataatcaacagcctgtaagcctaaaaacccctgagataaactgcgatatttccccggtataacatggaggtctatcgattcgtatttagaaagcgcattcattgcaagcagcgagttggtataaaaagtacagttttcggtacggaaaatttcctttgccacggcgagggtcgtggttcccgtttcgataaatactgagcttcccggcttcaccagttgcttacaccagccagcaatgcattttttagcgtcgggatttgcttcttctttgagggacatcgggtactcagaggcgttcctttcacaggtgatagcaccaccgtaaatcaactgtattgcaccggtactcgccagcgctttaaaatcccgattgatagtcatcgtcgaaacattcagcttgcgggctaaatcctgcgtgttcacctcaccattaaccttaatggtttcaagaatatagatttgccgtttggtttgtttcatcaaactttctctcaaaggtattatcagcgcgctaatgctaattaaatacagataaaacaagaaattacacttgtttatagacatccggcaagcataaacccctcaggttcgttatttctgctgctcatctgtgaggtagagcacagttgggtgttattttgataattttgcgtgatctgctgctcacttagtgatcaaagtataacataaagcaacattttatgtttattgtgttgccttgtaacaaagtgcatagcctaaagaagcttttattatccaatcttataactctcgcaaggagggagtgttatggggaaatatacggaaatgtccagacttgccatagggcatcttggtggaaatgaaaatattagtcatgtaacccattgtgcgaccagacttcgcatagatgttataaaaagaagtcatgtaaattctgacgcaataaaaaacctaccggattgcgcaggcgtcatcattaaagataagcaaatccagattatcatcgggccaaatgtgaatgatgcctggcatgattttgttgcggtttctgggtggaaggagagtgcaggcgagcggggcagtaatgacgtagaggaagatggcccacgtaatgccgcctggtatctgaataagttcggaaactttgtttcgcccattttcatgcctgtggtaccagcaatgattgtcggcggtatgatccttgcgatacgtaatctgctaatgaactattttggtatggatatcaatagcggaacggcaaacgtattactggcgatatttcaggctggctttacctttctgccagtttatattggttatactctcgcatcgcaactgaaaatgcagcctattatgggcgcatttttaggggcggtattgctgacggaaaggataaatgatgttgctggcctgaattttcttgggataccgatcccgcagattgattacggttcagccattttgccgattattctcggtgttttcttcatgtactatgttgataaagtgctgaagaaaatcattcccgaagccgttatctactttgtaaaacccctgctgacaatgtttatcgtagtaccagtacagctaatcatactggggcctctggggacttacttaagcggtgcgataggtgatttctgtatctggttaggcgatgccgtgggtttcctttcgcaacctattctggctgcggtttatccgtatatggtgatgctcggcatcgataaagctatctctcccatttctgttcacctaatcgcaaccgttggcttcaactcggttaccgggaccatggggtttatctcgaatatttgtatcggcgcgaccgctctgggagttgccagcagtattaaaaacaataaagcccagaaaggtatgatcgcctcctttgccgtaacggcgctgtgtggtgtcaccgaacctgcattttatggcagcttgctgatgcgacccaaagtacttattggtaccgccgtgggggcagtgagtggtggggttattgctggcctgatggggcttcgctctttcgttgaaggtggatgccctggtctattaacgtttttattctttgttgataaaagtgggagcctgcattacgtaataattgccgcaattgttgctgtcgtggcgatactggtatcgttttttgccaccagaatcattttatcattagataataaaaatttgcttagccaccggactgtatctgaataagtgcgatgcaccacacattttaaataggtgaaagtgatttcttatatccggataaataaggactataaaaatgaaagtactcgttggccatttcatgacggagtcaaatgcaaatattccgcttaagaataaaatcagcgattttcttttatcattcggcgatgaatgtattgaaagaatgcatgtgggaactgttttcgctgaagcaggtattgaattaattccggcggtctatgctgatgcaggctcgtcgggcgtcataaccaaagaggcattcgactacattgaacattgtttcctggacgcgacgcgcaaccacttgcatgaaattgacggcatttatctgatgttgcatggtgccagccaggttgaaggccttggctcaggcgatcatcatatcctgaagaaaatccgtgaaattgttggcgattatatgcctgttgccgtggtatgcgatcctcatggtaatttatgtgcggattatgtgaatgccaccaccctgatccgcagctacagagagtcaccccatacagatagccttgataccgctaaacaggtggcgtcaatgctctgtaacctcctcagagagcgtcagaatattcactctgtctatcgtaaactgcctctaattctgggcggcgaacaaagcgtctcatccgacgaacctgtcaaaagtatcaatcactatatgaatgaattggaaaatgatccacggatcatgagcgtcagctggcatccaggctatatacgccatgatacggatgtcgccgggtgtgggatcgttgtggtacccgctacggcagaggatcaatcttatgctgaagagatagccgatcaactggcagattatgtgtggaataaacggcatgaatttcattataccggattaaccgcgcagcctgatgaagctttaaaaatggcactggcgtttaaagataaaccggtatttattacggattccggggataacacgacatccggtgctaccggatggaatacttatattctgcgccagtttttagaggtcggcgatctgactaaaaaagtattgtttgccaacatttgcgatccgcaaacttatcagcaacttagtcagctgggaataggtgaagaagcgcatattaaccttggcgtcgattatgatgagatgtccaaaagcgttggtcttgacgttacggttaaggcccgtggcgagctacgcggttatatgcttcatcctcatgaggcctgctatggatacagtgttaccgtctcagtaaaaggaagacctgttgatattgtggtagccagcacccggcaaacgatggcagagcaacatcagtttactggcgcagggcttgactgggatgaatatgacatcattgtcgttaagcaaggctatatttttcccgagcttaaagaaaaagggaaattatgtgtgatgtcccttacccccggcgcgacgcctcagaatacacgcgccatccctttcaaaagaattatgcgccccatgtttccgatcgatgatatttgacatattgctttgcacggtgattggtaaaagaggttaagatgaaaaaatatgacataaggcttaaaaaaatccggccacccgagaaagattgcgcaggcacgcctgtggcactcacggatgaaaccatccagcacagaaaaaacaaaatactgaccatgatgaagcaacgtggccttgagcagttggtgatctatggtgacgtggaacattgcgggaatttcgagtacctcaccggtttttttacccgctttgaagaggcgctgatggttattaacgtcgatggtgaaataaccctggtgctcggcaatgaaaatctcaacaaagtcagtaaggcgcgcgtcaaggccagggcagtgcatttatctcatttttcactgcctaatcaacccaacagaaacgataaatcgattaaagaattacttattgaagccggtattcgtgagaatgcgcgcaccggtttagttggctggaagatgtttaccgatggttcagcgatcgataaaaagatttatgatttgccttcttttatcgtcgataccattcgcaacatcgtcggcaatgaagcctgtttgaccaatgaaatcgatttatttatcggcgaaaacggtgtcagaacggtaaacaatgctaacgaaatcgcgcactatgaatatggtgcggcgttagcctccgattgtattctggatgcgatgaacgcgctggctcctggcgttaccgagcaggaattaggcgatcgtctggtgcgttcaggtcagcatacaaacattgtcaccatcgctgccagcgggccgcgctttataaaaggtaacctgtttcctggcgagaacacggtgaaatatggcgatacgatttcattgaccgtaggctatcgcggcggcgcttccagtcgcgccggatatgccgtaaacggttctaatctcttatcaaccggggcggaaaattatctggacgcgatcgcccgaccctattttgcggcctatgttcactggctggaagcgatcaccgtaggtatgcgcggcggggaactgtttgatcgtatcgacgcgatattaccacgggaaaaatatcactggtcgctttgtccggggcacctgaccgctgaagaagagtggatgtcttctcccatttacgaaggctctcagcaaacattgcagagcggaatgatcctgcaaattgacatcattccttccatccccaatcttggcggcgtttctgcggaaagcaccgtactgctggcagacaaacagttgcaacgggaaattgagtttcagtacccacagctatggcagcggatgcaacggcgcaggcattatcttatcgaaacactgggcatcaacctgtccgcggacatcttaccgatgtgcagtacagttgcttatttgcgcccctggttgctggaccatgacaccgcctttgtctgccattttttgcaaaaaggggtagacaagtgcgaatgataatgattattattgccatgcgttcagggggaccgctacggtaaacctgaaagcacgacattgctcacattgcttccagtattatcttagccagccgcgtgctggctttttttttgccatgttgtcaccccggcatttgcgctatggttatgaaagtaaccttaaaaaggacgataccatgaccctgcattgcgcatttattggatttggcaaaagcaccacccgctatcaccttccgtacgttctcaaccgcaaagacacctggcatgtggcgcatattttccgccgtcatgcgaaaccggaagagcagcagccgcagtatcagcatatccatttcaccagcgatctggacgaggtattaggggatccgcaggtaaaactggtggtggtctgcacccatgccgacagccattttgagtacgcgaaacgcgcgctggaagccggtaaaaacgtactggtagagaagccattcacgccgacgctggccgaagcaaaaaccttatttgaactggcgagaagcaaaggtctgaccgttacgccgtaccagaatcgtcgctttgattcctgcttcctgacggcgaaaaaagccatcgagagcggcaaactgggggatattgtcgaaatcgaaagccatttcgattacttccgtccggtggcggaaaccaaacccggcctgccgcaggatggcatgttttacgggcttggcgtgcacaccatggatcagatcatctcgctgtttggccgcccggatcatgtctcctatgacatccgcagcctgcgtaacaaagccaacccggatgatacctacgaagcgcagctgttttacggcgacctgaaagccatcgtcaaaaccagccactatgtgaagatcgactacccgaaatttatcgtccacggcaccaaaggctcgtttgttaaatacggtatcgatcagcaggaaaccagtctgaaggccaatatcatgccgggcgaggcgggctttgccgccgacgatagcatcgccacgctggagtacgttaatgacgctggtgaaaccgtgcgtgaagagtggcctgcggaaaccggcgactatggccgggtctatgatgcgctctacgccaccatcactgaggggcagccgaattacgtcaaggaatctgaagtaatgaccaacctcgagatcctggagcgcggctttgagcaggcctcgccatccaccgtaaccctcgctaaataagcggatttggctcctctgcacttgttcactttttttgaacagaggagtcaattttcacccactatcatcccgaatcgattacgtccacacttactccatcgaaaacagacggggtgaaaaaaatgattttcttacgcaaagcaaacgaacgtggtcatgcaaatcatggctggctggactcctggcacactttctctttcgccgattattacgatccgaactttatgggattctctgcgctgcgcgtcattaacgatgacgtgatcgacgcaggccagggcttcggaacgcacccgcacaaagacatggaaattttgacctacgtgctggaaggggcggttgagcaccaggacagcatggggaataaagagcaggttccggctggtgaattccagatcatgagcgccggtaccggcgtgcgtcactcggaatacaacccgagcgccaccgacaagctgcacctgtatcaaatctggatcattccggaaaaaaccggcatcacgccgcgctacgaacagcgccgctttgacgccgcccagggccgccagctggtgctgtcgccggatgcccgtgacggttccctgaaggtgaatcaggatatggaactgtcccgctgggcgctgctgaaagatgagcagtcggtttaccaggtggctgcagaacgccgcatctggatccaggtggtgaaaggtgaagtgtccatcaacggcaccaaagccaccacggcggatggtctggcaatctgggatgagcaggcgctctccatccatgccgacagcgacagcgaaattctgctgtttgacctgccgcctgtttgatcccgcttaaataaataacacaacctccccgtatctgcggggaggttgtctgctgtccgtgataaactggagcaatgttttcccgtttatcacacaggcacgatgaaaaagaaaagacccgtacttcaggacgttgcagatcgcgttggcgtgaccaaaatgaccgtcagccggttcctgcgtaacccggagcaagtctccgtcgcgttacgcggcaaaatcgctgctgcgcttgatgaactgggttacattcccaatcgcgccccggatattctctccaatgccaccagccgcgccattggcgtgctgctgccttctttgaccaaccaggtttttgccgaagtgctgcgcggtattgaaagcgtcaccgatgcgaacggctatcagaccatgctggcgcactacggctataaaccggagctggaagaagagcggctggaatcgatgttttcctggaatatcgacgggctgatcctcaccgagcgcagccacacgccgcgtacgctgaaaatgatcgaagtggcgggcatcccggtggtggagctgatggacagcaaatctccgtgcctggatattgccgtcggttttgataacctggaagcggcgcgccagatgacggcggaaatcatcagccgcgggcatcgccacgtcgcctatctgggtgcacgtctggatgaacgtactatcatcaaacagcgggggtatgaacaggccatgcgtgaagccggtctgacgccttacagcgtgatggtggagcaatcctcatcttacaccgccgggattgaactgatgcgccaggcgcgtcgtgaatatccgcagctcgacggcattttttgtaccaatgacgatctggccgtcggcgccgcctttgaatgtcagcgtctggggttaaccattcccggcgacatggcgattgcgggttttcacggccacgacatcgggcaggtaatggagccgcgtctggccagcgtcctgacgccgcgcgaacgtatgggccgcatcggggctgagcgcctgctggcgcgtattcgtggcgaaaccgtgacgccgaaaatgttagatttgggttttaccctgtcgccgggcggttccatttagtctgacaaatttgaagtggctcacatttattcacttctggcgcgaatggatattgcttctccgcatccccggcatgaaaatgttaccgataactgttacccgtaacaattgacctcagcacgagtgggagcaacgccttgagtacgacaaatcttgatcaccatgtctatgtcctgatgggcgtatcgggcagcggtaaatccgccgtcgccagcgaagtggcgcaccagatccaggccgccttcctcgatggcgatttcctgcatccgcgcagcaacatcatgaaaatggctgccggcgatccgctgaatgacgacgaccgcaagccgtggctacaggcgcttaacgacgccgcttttgccatgcagcgcactaataaagtgtcgctgatcgtctgctcggcgctgaaaaagcgctatcgcgatctgctgcgtgacggtaacccgaatctttcttttatttacctgaagggcgaatttgacgtgatcgaaacccgcctgaaggcgcgtaaaggccacttctttaaaacccagatgctggtgacgcagtttgatgcccttgaagagccgggcagcgacgagcaggacgtgctggtggtggatatcgatcagccgctggacggcgtggtcgccagcaccattgcggtgattaagcagtaacgccgggaagtgaaacaggtaacatcgtaagacgccgggaagggcacaagcctgcccggcttttttattagcttttcatccacgcgcggatgccgtccaggaacatctgggtggcgagcatcaccaggattagccccatcaggcgctccagcgcgttcacgcctttatcccccagcagacgcaggaataatgacgactgcaacagaatcgccacggtgccgccccaggccagcagcagggcgatgaccagatgccccatctgattcggatactgatgcgataacagcatcagcgtggcgagcagcgtcgggcctgccaccagcgggatggcgagcggcacgataaacggctcttcgcccgcaggcagcccgtggctgccgccggtcgggctgggaaaaatcatcttaatggcgattaaaaacagaatgatgccgcccgaaatcgacacggtttcagcgcgcagattcaggaatgacaggatcttctcgccggcaaacagaaaaatcagcatcaaaagcagggcgatcagcagctcgcggatcataatggcccggcggcgcttcggctccgtgtgcttgagcaccgacataaaaataggcaggttgccgagtggatccataatcaggatcaacagcaccgcggcggagatgatttcgttcatttaatactttccctaatactcgccccagattttttgcctataagctctatttctgacgacgtcgctatcattgattaatttcacttgcgactttagctgcattttgtaaggtgaagggacgccagtcggaaactggttcgcacacacagcacacaccttcgcaggaaaaatacgctatgaaaaatgttggttttatcggctggcgcggaatggtcggctccgtactcatgcaacgcatggtagaagagcgcgatttcgacgccattcgcccggttttcttttcaacgtcccagctgggtcaggccgcgccgacattcggtagcacaccggctggcacgctccaggatgcgtatgatctggaggcgttgaaggcactcgacatcattgtcacctgccagggcggcgattataccaacgaaatctatccaaagcttcgtgaaagcggctggcagggttactggatcgatgccgcctcgtcgctgcgtatgaaagacgatgccatcatcattctggatccggtcaaccaggacgtgattacccgcggcctgaacgagggcgtaaaaaccttcgtcggcggtaactgcactgtcagcctgatgctgatgtccctcggcggcctgttcgcccaggatctggtggagtgggtgtcggtggcaacttaccaggcggcttccggcggcggcgcgcgccatatgcgtgaactgttaacgcaaatgggccagctgcatcaccacgtctctgacgagctggctaacccggcgtcggccattcttgatatcgaacgcaaagtgacggcgctcagccgcagcggcgagctggcggtggacaacttcggcgtgccgctggcgggcagtctgatcccgtggatcgacaaacagctcgataacggccagagccgcgaagagtggaaaggccaggcggagaccaacaaaattctgcgtacctcgtccgtgattccggtcgacggtctgtgcgtgcgcgtcggcgcgctgcgctgccacagccaggctttcaccattaaactgaagaaagatgtgtccattcccacagttgaagagatgctggcggcgcataatgagtgggcgaaagtggtgcctaacgaccgcgacatcactatgcgtgaactgaccccggcagcggttaccggtacgctgaccacgccagtcggtcgtctgcgtaagctcaacatggggccggaatatctctctgcctttaccgtcggcgatcagctgttgtggggcgccgcagagccgttacggcgcatgctgcgccagctggcgtaagacttatattcagagcggaggtgcggtgtcacctccttttttttgcgtattacatggaggaaacgcgaatgtttcaaataagtcgggagataaacgtagtgttggctatgctttaagttgggcgtagtcccggcggaagtgaaagctgccggtacgccattcaggccaaaaaagtgccgccatccgtggtcagttcacggctgaacgctatggcacacatataaaaggatgaagaaaccatgtccagtcttgtcgatagagacgtgattaacgcgctaattgcaggccactttgcggatcccttttccgtactcggcatgcattacaccgatgccgggctggaagtccgcgcattgctccctgacgccaccgaagtttgggtgatagaaaccaagaccgggcgcaagctcgccaggcttgaatgcctcgattcgcgcggctttttcgccggcgttattcagcgtcgcaaaaatcctttccgctatcagcttgccgtcgtctggcacggtcaggaaaacctgattgatgacccgtatcgcttcggcccgctgatccaggatctggatgtctggctgctgtcggaaggcacccacctgcgtccgtacgaaaccctcggcgcgcacgccgataccatggatggcgtgaccgggacgaaattctccgtctgggcgccgaatgcccgccgcgtctcggttgtcggccagttcaactactgggatggccgtcgccacccgatgcgtctgcgtaaagaatccggcatctgggaactgtttatccccggcgcacacaacggtcagctgtataaatacgaactgctcgacgccaacggcaatctgcgcatcaaagccgacccttatgccttcgaagcgcaaatgcgcccggaaaccgcctcggtgatctgcggcctgccggaaaaagtggagcagagcgaagagcgtaaacgcgctaatgacttcgatgcgcctatctccatttatgaagtgcatctgggttcctggcgtcgccacacggacaacaatttctggctcagctaccgcgatctggcggatcagctggtgccgtacgccaaatggatgggcttcacccatctggaactgctgccgatcaacgagcatcctttcgacggtagctggggctatcagccgaccggcttgtacgcgccgacccgccgtttcggtacccgcgatgacttccgctatttcatcaatgccgcgcacgccgcaggcttaagcgtgatcctcgactgggtgccgggccatttcccggaagatgattttggactggccgaatttgacggtaccgacctgtatgagcacagcgatccgcgcgaaggctatcatcaggactggaacacgctgatttataactatggtcgccgcgaagtcagcaactacctgatcggcaacgccctgtactgggttgagcgcttcggcattgacgccctgcgcgtggatgccgtggcatcaatgatttatcgtgactacagccgtaaagaaggggagtggatccctaacgaatacggcggccgcgaaaatctcgaagctatcgagttcctgcgtaaaactaaccgcgtactgggcgaactggtgcctggcgcggtcagcatggcggaagagtccaccgacttccctggcgtctcacgaccgtcggataacggcgggctggggttctggtacaagtggaatctgggctggatgcacgacacgctggattacttcaagctggatcccatctaccgtcagcatcaccaccataatctcaccttcggcatgctgtacaactacaccgaaaacttcgtgctaccgctgtcgcacgatgaagtggtgcacggtaaaaaatccattctggatcgtatgccgggagatgcgtggcagaagttcgccaatctgcgtgcctactatggctggatgtgggctttccccggcaaaaagctgctgtttatgggcaatgaatttgcgcaggggcgtgagtggaaccacgacagtagcctcgactggcatctgctggaaggcggcgacaactggcaccacggcgtgcagcgtctggttcgcgatctcaaccacacctatcgtcatcataaagcgctgcatgagctggattttgatggctacggcttcgaatggctggtggtggatgacagagagcgctcggtatttgtttttgtacgccgcgataaagcgggcaacgaaattatcgtcgccagcaacttcacgccggtgccgcgtccgggttaccgtttcggcatcaatcagcccggcaaatggcgcgaaatcctcaatactgactcgatgcactaccacggcagcaatgccgggaacggcggcgcggtacagagcgagcagattggcagccatggccgtgagcattcactgtgcctgaccttacctccactctccactatctggctggtgcgggagggagaatgaccatactcacggcagggaagcctgagccgctcggcgcgcatgtcgtcgacggcggcgtcaacttcacgctgttttccgcccatgcggagcgcgtggagctgtgcgtgtttgaccaggaagggaatgagcaacgttatgacctgcccgcccgcagcggcgatgtctggcacggttttctggcgggcgcgcgcgccggcctgcgctatggctaccgtgttcacggcccctgggcgccggagcacggacatcgctttaatccggcaaaagtgctgatcgacccctgcgcccgtcgcgttgacggagaactgttggacgatgcgctgttccacggtggttacgagcgacccgatccccatgacaacgccgccatcgcgctgaaaagcgtggtggttaaagacgtttttgactgggaagacgacgcgccgccgcgcacgccctggggcaacagcgtgatttacgaagcgcatgtaaaagggctgacgtatctgcatccggatattccgcaagccgagcgcggtacctacaaagcgctccgccatccggccatgatcgcttacttcaaacgcctcggcattacggcgctcgaactgttacccatcgcgcagtttgccagcgagccgcgcctgcaacagctcggcctgagcaattactggggctacaacccgctggcgatgtttgcgctcgatccgcgctatgccgttgatccggaacgtgcgcggcaggagttttgcgagacggtaaaagcgctgcatcaggctggcattgaagtcatccttgacgtggtgcttaaccacagcgctgaaattgatcttgatggtccgaccttctccctgcgcggaatcgataaccgtagctattattgggtaaggggagatggtgattacgaaaactggacgggttgcggcaacacgctaaatttaaacttgccagccaccgtggagtacgccgttcagtgtctgcgctactgggtggaaaccttccatattgacggttttcgctttgatctggccccggtcatggggcgcacgccgggctacacgccccatgcgccgctgttcgaggccattgcagccgatccgctgctcagcgcggtgaagctgattgcagagccctgggacgtaggggcgggggggtatcaggtggggaattttccgccgttgtttgcggagtggaacgatcatttccgcgatgccgcgcgccgtttctggctggcaaaagatctctccctcggagagtttgcccgccggtttgccggatccagcgatgtgtttaaacaacggggtcgcgcgcctggcgcgtcggtcaacctgatcaccgcgcatgacggttttaccctgcatgactgcgtttgtttcaatcagaaacacaacgaggcgaacggcgaggaaaaccgcgacgggactaacaataaccatagtaataaccatggtatagaaggattaggcggctctctacatgtgactgaacggcgtcgggatagtgtccatgccctgctgaccacgctgctcctgtctcagggaacgcctatgctgctggccggtgatgaacaggggcacagccagcatggcaataacaatgcgtattgccaggataacgcgctgacgtggctggactggcgtcaggcaaatgacgggctgatcactttcactgcggcgctcattgccttgcgtcagcagatcccggcgttaaccctgaacgcctggtgggaagagggtgacggcaacgtgcaatggctgaacaaagacgctcagccattacgtcctgaggagtgggcgcaaggcacgggtcgaatgcagatcctgctgtcggagcgttatttaatcacgctcaacaacacggacgacgtagcgcaaatcgttttacccgatggggaatggcgtgctgttcccccatttgccggtgaggataatccggttgtaatggctgtctggcatgggcccgcgcacggaatttgcgttttcaaacggtcttaaaaaaggagttcatcatggttagattagataaaaacgatccgctaatgttagcgcgccagctcccattaaaatcggttgccctgattcttgcaggggggcgtggtacgcgtctgaaggacttaaccactacccgggcgaagcctgcggtgcactttggtggcaagttccgcattatcgacttcgcgttgtccaactgcattaactccggcatccgccggattggcgttatcactcagtatcagtcgcatacgctggtgcagcacatccagcgcggctggtcgttctttagcgaagagatgaacgagttcgtcgatctcctgcctgcccagcagcgcgtacacggtgaaaactggtatcgcggcacagcggacgcggtgacgcagaacctcgacatcattcgtcgctataacgcggaatacatcgtgatcctcgcgggcgaccacatctacaagcaggactactcgcgcatgctcattgatcatgtggagaaaggtgcgcgttgcaccgtggcctgtctgccggtgccgattgccgaagccaccgcctttggggtgatggcggtcgatgaaaatgaaaaagtggtcgctttcgtcgagaagccggaaaacccgcccgcgatgccaaacgatccgacacgggcgctcgccagtatgggcatctatatttttgatgctgactatctgtttgagctgctggaagaagatgatgcggacgacacctccagtcacgactttggtaaagacatcattccgaagctgacgaaagcgggcatggcgtacgcgcacccgttcccgttatccagcgtgcagtccgatccgaatgccgagccgtactggcgcgatgtcgggacgctggaagcctactggaaagcgaacctggatctggcctcggttacgccagaactggatatgtacgatcagaactggccaatccgtacccatatggagccgctgccgccagcgaaatttgtgcaggaccgttccggcagccacggtatgacgctgaactccctggtatcgggcggctgcatcatctctggctccgttgtggtgcaatcggttcttttcccccgcgtgcgggtgaactcattttgtaatatcgactcatccgttctgttaccagacgtatgggtagggcgttcctgtcgcctgcgccggtgcatcatcgatcgcgcctgtcagataccggaaggcatggtaatcggcgaaaacgcggaagaagacgcgcgccggttttaccgttcagaagaaggcattgtgttagtcacgcgggaaatgttgaataaactcaaaggctaacagcatcaagaataaccttgcgcggaaggggtccgcgcgctgttttaccgaacccgcaaacaggcggcggtaattaacaggagcgagaatgcaggttttacatgtatgttctgaaatgttcccgctgcttaagacgggcggtctggcagatgtccttggcgcgttacccgcggcgcaaatcgccggtggagtagatacacgcgtccttttgcctgcttttccagatattcgacggggcattaccgatgcacgagtggtgagtcgacgcgacacttttgccggtccattcactttactttttggtcattataacggcgtggggatttacctgattgatgcgccgcacctttatgaccgcccagggagcccgtatcacgataccaatctttttgcttacaccgacaacgtgttgcgctttgcgctgctgggttgggtaggcagtgaaatggcctgtggtctcgatccgttctggcatcctgacatcgtgcatgcccatgactggcatgcaggtctggcaccggcgtacctcgcggcgcgcggccgtccggcgaaatcggtgtttactgtgcacaacctggcctatcagggcatgttttatgcacatcatatggatgagatcgaattaccatcatcattctttaatgttcatggtgtcgaattcaacggtcagatctcgttcctgaaggctggtctgtactacgccgatcatattacggcggtcagcccgacctacgcgcgcgagatcaccgagccgcagtttggctgcggtatggaaggcctgctgcgtcagcggcatctggaagggcgtctttccggcattctgaacggggtagatgagaaaatctggagcccggataacgatctgcttctcgcggcgcgatatgatcgcgattcgctggaggagaaagccgaaaacaaacgccagctgcaggtggcgatgggtctgaaggtgaatgacaaagtgccgctgtttgcggtggtcagtcgcctcaccagccagaaagggctggatctggtgctggaagcgttgccgggcctgctggagcagggcgggcaactggcattactgggggcaggcgatccagtattgcaggaaggcttccttgcggcggcggcggaacatccgggccaggttggggtgcagatcggctatcacgaagccttctcgcatcgcatcatggggggagccgatgtgattctggtgccaagccgatttgagccgtgcgggctgactcagctctacggcctgaaatacggcactctgccactggtacgtcgtaccggcggtctggcggataccgtttcagacagctcactggaaaacctggcggacggcatcgccagcggatttgtctttgaagacagtaatgcctggtcgctgttacgtgcgataaggcgtgctttcgtgttgtggtctcgtccgtcgctgtggcgcttcgtgcagcgtcaggcaatgggtatggatttcagctggcaggtagcggcgcagtcctaccgggatctgtacaaccgggtgaaataatttccaggaatcgctcatatgaatgcaccttttacgtatgcatcacccacgctgagcgtcgaggcgctcaagcactcgatcgcctataagctgatgttcaccatcggcaaggatccggtgatcgccaataaacacgaatggctgaacgccacgctgttcgccgtgcgtgatcgtctggtggaacgctggctgcgctccaaccgtgcgcagctgtcccaggaaacccggcaggtttactacctgtcgatggagtttctgattggccgcacgctctccaacgccatgttgtcattaggtatttacgacgacgtaaaaaacgcccttgaagagatggggctggatctggaagagctgatcgacgaagaaaacgaccccggtttaggtaacggcggtctgggacgcctggcggcctgcttcctggattcgctggcgaccctcgccctgccggggcgtggctacggtatccgctacgactacggcatgttcaaacagaacatcgtcgacggacgccagaaagagtcgccggactactggctggaatacggtaacccgtgggaattcaagcgccacaacacgcgctataaagtgcgttttggtggacgtgttcagctggaagggaaaaaatcccgctggctggaaacggaagaaattctggcggtggcttacgatcagatcatccctggctacgacaccgacgcgaccaacacgctgcgtctgtggaacgcccaggcgagtagcgcgattaacctcggtaaattcaaccagggtgactattttgccgcggtggaagataaaaaccactcggaaaacgtctcccgcgtgctctatccggacgactccacctattccgggcgcgaactgcgcttacggcaggagtatttcctggtgtcggcgacggtgcaggacatcctcaatcgtcactacatgctgcacaaaacctacgccaatctggcggacaaaatcgccattcacctcaacgatacgcatccggtgctcggtattcctgagctgatgcgtctgctgatggatgagcataagttttcctgggatgatgctttcgaagtgacctgccaggtgttctcctacaccaaccacacgctgatgagcgaagcgctggaaacctggccggtggatatgctcggcaagatcctgccgcgtcatctgcaaatcatctttgaaatcaacgactacttcctgaagaccgtgcaggatcagtatccgaatgacaccggcctgctgagccgcgtgtccatcatcgacgaatccaacggtcgccgtgtccgcatggcgtggctggcggtggtggcaagccataaagtgaatggcgtgtccgaactgcactccaacctgatggtgcagtcgctgtttgctgatttcgcgaagatcttcccgacccgcttcaccaacgtcacaaacggcgtcacgccgcgacgctggctggcgctggcgaacccgccgctgtctgaagtgctggacgaaaatattggccgcacctggcgtaccgatttgagtcagttgcaggagcttgagcagcacattgatttcccggcggtcaaccaggcagtgcgtcaggcgaagctggagaacaaaaagcgtctggcgatcatgattgcccagcagctgaacgtggtggtcaatccaaaagccctgttcgacgtgcagatcaagcgtatccatgaatacaaacgtcagttgatgaacgtgctgcatgtgattgcgcgctacaaccgcatcaaggccgatcctgaggcgaactgggtgccgcgcgttaacatcttcgccggtaaagcggcgtcagcctattacatggcgaagcacattattcatctcatcaatgatgttgccaaagtggtgaataacgatccgcagatcggcgacaaactgaaagtggtgttcatccccaactacagcgtcagtttggcgcagatgatcattccggccgccgatctctctgagcagatttcgctggccgggacggaggcatccggcaccagtaacatgaaattcgccctgaacggcgcgctgaccatcggcacgctggatggcgcgaacgttgagatgcgggaacacgttggcgaagagaatatctttatcttcggtaacacggcggatgaagtggaagagctgcgccgtcagggttacaaaccgcgtgattactacgagcaggatgaagagctgcgcgacgtgctgacgcagatcgccaccggcgtattcagcccggaagagccgggccgttaccgcgatctggtggattcactgattaacttcggcgatcactatcaggtgctggcggatttccgcagctatgtggattgtcaggagcgtgtggacgagctgtatcgtcatccggaagagtggaccattaaagcgatgcataatatcgcggcgatgggctatttctcctcggaccgcaccatccaggagtacgccgacaagatctggcatatcgatccggtacggctgtaaatcagtacgataaacggggcctgaaggccccgttttttattatgatgctaacgacagttcgcgtttgccgtggcgcgtcagccactgcgcaatgcgcgactgctgctcagcattgagccacatcccctgcttggtacgacgccagatggcatcgtccaggcgacgcacccattcgtgctcgaccaggtaacgcagttccgcttcgtaaaactcatgcccgaaatcttcgcccagatcggccaatgaactcgcgccgccgaggatcagttcgctgttgctgccgtaagtgcgcgcatagtgacgcgccatctgctcgctgataaacggatagcgacgacgcagtttagccgcgtagtcatcgcgatcgccctgcagatcgccgcccggcagcacgcagtctttcgtccacgccgggccaatgtctttatagtaagtcgacagtttttccatcgcgtgttctgccagcttacggtaggtcgtcagcttgccgccgaataccgacagcaacggcgctttgccgttttcgtcgtgaatatccagcgtgtaatcgcgggtgatcgcctgcggcgaatcggattcgtcatcgcacagcggacgtacaccagagtaagtccagacgatatcgtcgcgcgccagctgctttttaaagtgcgcgttatagaccttcagcaggtagttgatttcgctttcgtcgatctcaacctttttcggatcgccctggtattccacatcggtggtgccaatgatggaaaactcatccatccacggaatgacaaacacaatgcgtttatcttcgttttgcaggatgtaagcctgtttctgggtatgcacgcgcggcacgacaatgtggctgcctttgatcaggcggataccgtacggtgacggcagctccatcccttcgtcgaagaactgtttcacccacgggccggtggcgttcaccagaccgcgcgcctgccaggtgtatttctcaccggtatcaacgtcttccgcttccaccacccacaggccattaacgcgttttgcggaggtggcgcgggtgcgggtcatcacttcgccgcctttgcgcacgaccatttgcgcattcgccagtaccagacgcgcatcgtccacccagcagtcagaatattcgaaaccgcgcacgatttcgggtttcattacggattctgcgccaaaacgcaaaccggcagatgcgggcaggctggtacgtttacccagatgatcgtacataaacagaccaatgcggatcatccacgccggacgcagatgcgggcggtgtggcagacgaaaacgcatcgggaaggcaatgtgcggcgccattttcagcagcacttcacgttctgccagggcttcgctcaccaggcggaactcgtagtgttcaaggtagcgcaggccgccgtggatcaatttagaactcgctgacgaggtggcgcaggcaagatcctgcgcttccagcatgagcacagataaaccccgccctgcggcgtctgccgcgataccggcaccattgatgcccccgcctatcacaatcagatctttggtttccatgttcgcctcatgcactttcgtaaaagctcaaaaatgttcgttatcgctcatgatagcaaaggaatggcgcattggtaacatcaaaaaaacaatttagagtgatatgcataacataatggcgtttacctgccgtgaagacgtaaacttgtcgctaagatgtggggccagcgtacccgccagaatttgcacaacgaaagagagcaccatggatcaatttgaatgtattaatgtggaagaaacccatcagaagctgcagcaaaagcaggcggtgctggtggatattcgcgatccgcaaagtttcgccatgggtcacacgcctggcgcgttccatctgacgaacgatacgctcagcgcctttatgcaggaacacgactacgacacgccggtgatggtgatgtgctatcacggcaacagcagcaagggcgcggcccagtatctgctgcaacagggctttgatcaggtctacagcgtcgatggcgggtttgacgcctggcaccgccattttcctggcgaggtggcgcacggatcgctttaaacctttatactgtcctcttttatgtggaataagtgcagccagcgatgttgatgatcacctcttttaccaacccgcgtatcgcccaggcgtttgttgattacatgcaaacgcagggcatcaccctgacgatccagcatcacgctaccaccgacgtctggctggcggatgaaagccaggctgaacgcgttcacgcggaactggcgcgctttttagaaaaccccggcgatcctcgttacctggcggcaagctggacgtcaggccagaccaacagcggcctgcattatcagcgctacccatttctggccacgctgcgccagcgggccgggccctttaccctggcgctggcggcgatctgtgttctggtatttatcatcatgaacgtcgtgggcgatgagccggttatggcctggcttgcctggccttacgatccctccctgcgctttgacgtctggcgttatttcagccacgcggtgatgcatttttccgtgctgcacattctgtttaacctgctgtggtggtggtatctcggcggcgcggtggaaaagcgactcggcagcggcaagctgattgtcatcaccatcatcagcgccctgctgagcggtttcatacaacataaattcagcggcccgtggtttggcggtctgtccggcgtggtctatgcgctgatgggctacgtctggctgcggggcgagcgcgatccgcaaagcggaattaatttgccgcgcggcttgatagccttcgccttagtgtggttaattgccggttggtttgatctgttcggcatgtccatcgccaatggcgcccatgtcaccggtctggttgtcggtctcgccatggcgtttgtcgatacgcaaaatgtgcgaaaacgaacataaattttccaggatatttcatgaagcagacacaacgccacgatgccattatcgaactggtgaaaaagcaggggtacgtcagtaccgaggagctggtggagcaattctccgtgagcccgcagacgatccgtcgcgatctgaatgaccttgccgatcagaatatgatcctgcgccatcacggcggcgcggcgttgccgtccagctcggtgaataccccgtggcacgatcgtaaagccacgcaaaccgccgaaaaagagcgtattgcccgcaaagtggcaagccagatccccaacggcgcaacattatttattgatattggcacgacgccggaagcggtggcgcatgcgttactggagcacagcaatctgcgggtggtaaccaataacctgaacgtggccaacacgctaaaaacgaaagaagacttccgcattattctggccgggggcgagttgcgcagccgggacggcgggattattggcgaagccacgctggattttatctcccagttccgtctcgatttcggcatcctggggatcagcggtattgataccgacggttcgctgctggagtttgattaccacgaagtgcgcaccaagcgggcgatcattgaaaactctcgccacgtcatgctggtggtcgatcattccaagtttggtcgtaacgcgatggtgaatatgggtagcatcagcatggtgaatgccgtgtacaccgacgtgatgccgcccgccggtgtcctgcaggtcatcaaggatcataatattcagcttgagctgtgctagcgaaacggggcttataccccgtatcccatcatcttcaatagctgctgcgcgtgctgcaccgcatcctgacggtgcgccacgccgagcttctgatacagattacgaatgtgcgttttgatggtggtggccgccaccgccagctcaccagcaatctgttcattgctgtagccggaatagatcagccctaaaacctgccattcccgctgggtcagcggactggtacggatcagctccggcacttccgggtgattgagcaggcgctccacaaagccttcatcgaaatgcgcgaacttgtggcgatgatgctggttaatgtcgcgaagtatgcgttgggcgcgatgcccttccagttccggcagggcgttaagctggatcagctggcgcagttgctgcgccatcgcttccccttcaatcacaaagtggctgataaagccggtgcggttagccagcgtcagcgcttccatcagcacccgctgcgcatcgcttttacgtcccgcctgccagtaaagctggttcagcagcagcaggttgcgattcagatcgctcatcagccgcagactgcgcgcgttttcgtttaactcttccagcaccatctccgccggatcgaaatcaccgagcaggatctgcgcgcgggcgatgttgcgccactggctttgcaggaaatggttatcggcgaattccggcttcggcgtctggcgcagccactgggctgcggcatttttgtcgccaatcatctgccagtaaatcacccgtactttatcggcgttggatacccagtcgctgtgatactggccgttaccgagcaggttttccagacggttaagatggctgcgggcgttgtccagatcgccgcgcgccagagagttctgcaccagcagcgccagacactgcatctgctgctgcggctggtaggcggcgagtacgttcagcccttcgcgggcggcggcttccgattcatccagacgcgcccacgcccacagcagttgcgcgcggatgcgcagtaaaaactcgtgcagcggcaactgctcaagatgctgctcgcggatcagcgcaaaggctttttcctgcgtttcccaggcggcctgtaaaaagccctgggcgaacagaatttcgctctgctggatgaggctccacagcgcgtaatgccagacgtcgtggcgacgcgccatctgctcggtctgctgcatcaccgccagcgagttggtcagctgtcctttgcaatgcagcacttcaccgtgtaccgaggtggcgacgatacggctgtagtaattcgccagcggcagctcttccagcgccacggtcgacaggcgctcggcttcggcgggatcgccggcgttaatcgccacctgcgcgcgcagggcgttgaaatcaccgtgcagggagcgatccatttccatgtccatctcctgctcggcgcgggccagcagggtgttcacttcgctgtagcggtactggctttgcatcagccacgcctgaagcagcaccaggcgcggattctccagcaggctttcccagggcagcgctttcagggattcttccagcagcgccagttcgctgtggttaaacagcccccaggcgtgatgcagcaggatgtcgcgcagcatgttgccatcgcccgcggccagcgcgtgatgaatggcttcgctggggaagccctgcgccatccagctttccgccgccgcgcggtggatctccggcagctcggtcgccagctcccactgacagcgctgacgcaggaagttaccgaacagcgggtgatagctgaaccattcaccggaatcatccatccgttgcagaaaaaggccctgacgttcgatctcttccaggcgcatctgcccgttttcttcgcccgtaacacgcacaatcagcgcgtcgttcatcgagcgcagcagggaacttttcagcaacaaatgacgggtactgagatcgatattatccagcacttcatccaccagataatcggaaagatggctggcattgatccccgcgaggcggcgcgcggactggtgcgcggcatggttattctggcgggcggagagggcgatgagctgtagcgcggtggcccagccggccacatcgtcgcacaggcggctgctctctgccggttcaatgggggattccaggcgacaatcaaaaaactgcttggcttcctgatgggtaaaggccagatgctgactgccgatttccagcagttgatcgcgtacgcgcaggttggcgatacccagttgcggcagattacgcgacagcaccaccagtgtcaggcattccggctgatggcgcaggaaaaagcgcatggcgtcgtggatcaccggattagtgaccaggtggtaatcatcaatcaccagatagagtgggcgatcccagtccgccagctcgataaacagctgggcaaacagcgacgacaggctggcgtactggcctttctgggcaatggcttcgctggtgacgcagtggccgtgggtggcctgctgcaccgccgccatcaaatagctggcaaagcgctcctgctgattgtccccctcatcaagagaaaaccatccgagatcgcttttccctgcggcccactgcgaaatcagggtcgtttttccataaccggcaggacttgtcaccagcgccaggcgaaaattgttggcgcccgcaagtttagccagcaatcggtcgcgcaccactgtgtggtcaaggcgaaccgggcgacttaatttagacggaatcaacatagtcatcacttcactgtgaggtaacgggaaaggcgattttttttgcgcttcgtaattaataaagaatacgttcggccagaatgacatgtattgcaagttatgtccgaatttgaccgcgcttaatttgcactgtgtcacaattccataacctttatgaatattacctccgacagccagccatggcgcatgaacactgaatcggcgataaagcgcgcaaacgaaaaaatgcgcttttttgactcgcagcgaatttaaatattatgaaaatcgatgtcagcttatgtctgccagaaatagccgtgacgcggtttaaattttcagcaaaataataaatttttcgcattgtatttacccgcagcagataattcccatgaaacgacatttcaattttttgagcatgttccgggttatcggcgaatgaccacggcagaatgcccgcatacaaggatgctaagtggccgcgatcacacttttcgctcctccccgctactcctccctttctaatccctggcaggatgaggtagccgaaacgggagccaggcacactagcactaatgttgttttttacttacaggatccgagttccctatgtcacagcccacatttaacacagcacaattcgaagcggccctgacgcgtcagtggcagcgttttggtcttaatgccgcagaccagatgacccggcagcagtggtggcacgcggtcagcggcgcgctggcggaattactgccggtacaggcagaagccccggccaaaaaccagcgccacgtgaactacatctcaatggaatttctgattggccgcctgaccggcaacaacctgctcaacctcggctggtatcaggaggtgagcgatgtgcttcaaacccataacgtcaacctgacggatttgctggaagaagagatcgatccggcgctgggcaacggtgggctggggcgtctcgctgcctgcttccttgactccatggcgacggtgggccaggcggcgactggttatggcctgaactaccagtacggcctgttccgccagtcttttgctgacgggcagcagcaggaagcgccggacgactggcatcgcggcagctatccgtggttccgtcacaatgccgcgctggatgtgcatgtgggcatcggcggcaaaatcagcaaagacggccactggacgccagccttcaatcttatcggcgaagcctgggatctgccggtgctcggctaccgcaacagcgtcgcgcagccgctgcgcctgtggctggcaaaacatgcccatccgttcgatctcacccgttttaacaacggcgatttcctgcgtgccgaacagcagggcatcgacgccgaaaaactgaccaaagtgctctacccgaacgacaaccatctggcgggcaaaaagctgcgcctgatgcagcagtatttccagtgcgcctgttcggtggcggatattctgcgccgtcatcacctcgccgggcgtaccattgcgcagttgccggacttcgaagtgatccagcttaacgacacgcacccgaccatcgccattccggagctgctgcgcgtgttgatcgacgaacaccagctcagctgggacgacgcctgggcgatcgccggcaaaaccttcgcctacaccaaccataccctgatgccggaagcgctggagtgctgggatgagaagctggtgaaagcgctgctgccgcgccatatgcagatcatcaacaccatcaataaccgctttaaatcgcaggtggagcaaacctggccgggggacaaagacgtctgggcgaagctggcggtggtgcataacaaacaggtgcgcatggcgaatctgtgcgtggtgagcggctttgccgtcaacggcgtggcggcgctgcactcggatctggttgtcaaagatctgttcccggaatatcaccagctgtggccgaataaattccacaatgtgaccaacggcatcacaccgcgccgctggatcaaacagtgcaacccggcgctggccgcgctgctcgacacgacgctgaaaaccgaatgggccaacgatctcgaccagcttcagggcctggaaaaatatgccgacgacgcggcgttccgcgcgcagtaccgcgatatcaaacgggccaacaaagtgcgtctggcaagctatgtgaaagcgcgcaccggcattgagatcaatccggaggccatttttgatattcagatcaaacgtctgcacgagtacaaacgtcagcacctcaatctgctgcatattctggcgctgtacaaagagatccgcgaaaacccgaccgccgaccgcgtgccgcgcgtcttcctgtttggcgcgaaagccgcgccgggctactacctggcgaaaaacatcatcttcgccatcaacaaagtggcggaagcggtcaacaacgatccccgtgtcggcgacaaactgaaagtggtattcctgccggattactgcgtgtcggcagcggaaatgctcatcccggcggcggatgtttccgagcagatttccaccgcgggcaaagaggcctccggcaccggcaatatgaagctggcgctcaacggcgcgctcactgtcggtacgcttgatggcgcaaatgtcgaaattgccgagcaggttggcgacgataacatctttatcttcggccatactgttgaacaggtgaaggcgctgaaggccaaaggctacgatccgctgaagtggcgcaaaaaagacaaagtgctggatgcggtgctcaaagagctggaaaacggcgtctacagcgatggcgataaacacgccttcgatcagatgctgcacagcatgggcaagcagggcggcgacccgtatctggtgatggccgacttcatcgcctatgtcgacgcgcaaaaacaagtggacgtcctgtaccgcgatcaggacgcctggacgcgagccgctattctgaatactgcccgctgcggcatgttcagttcggatcgctccatccgtgattatcagacccgtatctggcaggccaaacgttaaggaaagccatggaaagcaaacgacttgatgccgccgcgctggcggcggggatcagccctcattacatcaatgctcacggtaaaccgcagtctattggtgcggaaactaaacaacgtttgctggacgccatgcatcgcccggccgccccgaaaaagggggcggttccgcctgtgccgccggtgaagatctttacccacggcaaaaaaatgccgctgcctgttgaaggcagcggggaattcagctggcggctgatcaccgaagagggccgggagtacaccggccaggccaccggcggtaaagcgctcaatctgccggcaaagctgccggagggctatcacacgcttgagatcggtaaggcgaaacagcaatggcagtgtcgggtgatagtcgcgccgaagcgctgctatgaaccgcaggcgttacacgaagggaaaaaactgtggggcgcctgcgtgcaactctacaccctgcgttcggaaaaaaactgggggatcggcgattttggcgatctgaaggccatgctggtggatgtggcgaagcggggcggctcttttatcggtctgaacccgatccacgcgctctacccggctaacccggaaagcgccagtccgtacagcccgtcatcccgccgctggctgaatatcgtctatatcgacgtgaacgccgtggaggatttccagcgcagcaaagaagcgcagaaatggtggaaactggcctccacgcaggatgcgctgcgcgctgcgcgcgacgccgaatacgtggattacgcgaccgttaccgcgttgaaaattgccgcgctgcgtctggcatggaaaggctttgccgcccgtaaagacagcgatgcgcagaaagtggcgttcaacgactttgttacgcaggaaggcgagagcctgtactggcaggcggcgtttgacgcgctgcacgcgcagcaggtgaaagaagatgagatgcgctggggctggccggcatggccggaaggctatcagcgtaccgacagtccggaagtgaagcagttctgcgaagagtacgccgacgaagtacagttttacctgtggctacagtggctggcctgcgagcagtttgcgcagtgctgggaaaccagccagggcttcgccatgccgattggcctgtaccgcgatctggcagtgggcgtggcggaaggcggcgcggaaacctggtgcgatcgtgaactttactgcctgaaagcgtccgtcggcgcaccgcctgacattcttggtccgctcggccagaactggggactgccgccgatggatccgcacgtcatgacggcgcgcggctacgagccttttatccagctcttgcgtgcgaacatgaaaagctgcggcgcgctgcgtatcgatcatgtgatgtcgatgctgcgcctgtggtggatcccgtacggcgaaaccgccgatcagggggcgtacgtgcagtatccggtggatgatttgctgtcgatcctcgccctggaaagcaagcgccaccagtgcatggtgattggcgaagacttggggacggtgccggtggagattgtcagcaagctgcgcgacggcggcatctactcctacaaggtgctctatttcgagaacagcgaaaacgtcttcctgccaccgcaaaaatggccggaacagtcgatggccgtggcgaccactcacgatctgccaacgctgcgcggctactgggaagccggtgatttaaccctgggcaaaaccctgggactgtatccggacgaagaggtgctgcgcggtctgtaccaggatcgcgagcgggcgaaacagggtctgctggaggcgctgcacaagcagggttgtctgccgaaacgtgccgggcacaaggcctcacgtatggcgatgaccagtacgctgaaccgcggaatgcagcgttatatcgccgattccaacagcgcgctgctcggcttgcagccggaagactggctgggtatggccgcgccggtaaatattccgggtaccagttctcagtacaaaaactggcggcgcaagctgaataccactcttgagaagatgtttgccgatgacggcgtgaacaggctgattaaggatctggacagaaggcgtaaaacggcagggaagaagtaagtattacattgcccctctccgtccggagaggggcaatagacagccgttaaatcaccgtagccagcagcagacaacccaccagaccacagaccgaaataatggtctccagcgccgaccatgacttcatggtttcaccgatagtcaggttgaagtactccttgaacagccagaaacccggatcgttcacgtgggagaaaatcacgctaccggaacccacggcgataaccatcagctcagggctgacgccggtggtggcgatcagcggtgcagcgatgccgccagccgtgatcgccgcaaccgttgcagaacccagcgcaatacgcagtactgcggcaatcgaccaggccataaagatcggcgataagttagtggagtgcatcatcgcggcaatgtatttatccacgccgctgtcgaccagcacctgtttgaacgcgccgccgccgccgatgatcagcagcatcatggcgatgattttaatggaagaagtgatggtatcggtcacgtcatccattgaacggccacggttcaggccgaaggtgaagatggcgatcagcacggcaatcagcgtggccataaccgggtcgccgaagaattcagcgtaaggcagcagcgcatggcctttcggcagcaccatttctgcaatcgcacggcccgccatcaggatcaccggtaccagagaggtccagacgctgacgccaaagctcggcatttcggcttcgctgaaggttttcgcgttgtacaggccttccgggatcggtttatcaatatttttcaggaaacgggcatacaccgggcctgccaggatcaccgtcgggatcgccagcagcgtaccgtagagcagggttttacccatatcggcgtggaagatagtggcgatagcggtcgggcccgggtgcggcggcaggaagccgtgcgttacggaaagcgctgccgccatcggcacgccgacgtaaagcagcggcacgcgcgcttttgcggcgatggtgaacaccagcggcagcaacagcacgaagcccacttcatagaacagggcgaaaccgacggtaaaaccggttaataccactgcccactgaatgtatttctgaccaaatttgtcgataagcgtggtggcaatgcgctgcgccccaccgcagtctgcgagcagtttgccgagcatagcgccgaagcccatgatcagcgcaaggctgccgagcgtaccgccgacacccgctttaatggaggcgatcactttgtctactggcatgccctgcatcagtccgacggcgagcgccaccaggatcagggcaataaatccgttcagtttaaaacggatcattaacaacagtaacaagacaacaccgatagcaacgatgactaatggcatgatttacctggcctttaatttgttatgggtaacgttaaacaccttactggcgttaccaattatcccgcagggggaacagagaacgcatcgcactgccccggcttgcttttagatttgaacaaaagtttagctggccgtttggggttaatgcagtactggcgcgaatgatacgggtaacatataaggaatgagaatgaccctggcggtttaaatgtgagaattgcgaggtgggtcaaattctggggaaaaggatgttaaatttttggtggcgggttgccgggtggcgctgcgcttatgaagcctgtaggcccggtaagcggagcgccaccgggcggggaacgtattaacacgtaggcccggtaagcgaagcgccaccgggcgggggagtgcatcagtagtaggagtgttcgccgcgctggtgttcggtcagatcgcgcacgcctttcagttccgggaactcgttcagcagctgcttctcgatcccttctttcagagtcacatcgaccatcgaacagccgttacaaccgccgccgaactgcagaatggcatagccttcttcagtaatttccatcagcgtaacgcggccaccgtgaccggccagctgcgggttaacctgcgactggatcatgtaatcgacgcgctccatcagcggcgcatcatcagacactttacgcattttggcgttcggggctttcagcgtcagctgtgaacccagctgatcggtaacgaaatcgatctccgcatcatccagatacggcgcgctcaactcatcgacatacgccgtcagcaggtcaaatttcagggcggtgtcagaagcttccactgcgtccggcgggcagtaagagacgccacattcagcgtttggggtacccggattgatcacaaatacgcggatttgtgttccttcttcctgatttgccagcagtttggcaaagtgcgcttgtgcagcgtcggaaatatggatcatagcaatggcctaatagttgactattttacctggttataatacgcccatcatcgaggctctacaaggttcgacacaggcaccatacctgaacagtcgccgcgccgccccgtaaaagcagctgagcaatctctgcgacggtgctgccggtagtgacgacatcatccacgatagcgatatggagtccgcgcaccggtaattcaaggcgaaaggcatgacgcagattatgtttccgccgtctggcgctgagctgatgctgaacgggcgtggcgcgaacgcgtatcagcgccgtgctgtcccaggcgcaggtcagccagcgggcgagcgggcggcagagcagatcgctctggttaaatcctctgcgccaccggcggcggcggtgaaggggcacgctgatcagtctgtcgggccagggcgatccccgctcacgatgggcgcgggcaacggccaacagcaacagacgcgccagcgcccgggccacttccggctggcgggagaacttcagccggtggatcaacgaactgagcggcggcacatagtcgtttaccatcaccagttgctgccagggcggcggtttttgcaggcaacgcccgcacggcaggccggaaagcgccgctggtaaaccgcactgcgggcagacggtctgcgtgataaacagcgcacggcagcacaccgaacagatgccccaggacgcgagcgccagcggcattcggcatagccagcataagccaggcactgatagcatagatcccctccctgttgatgaaagagaagcctaactgatgaatgacctgtggtgggaaaccaaaggcgaaggaaagtgtcatcttgtgctgctgcacggatggggactgaatgcgcaggtatgggattgcataacggcggaactcgtgccgcattttacgctgcatctggtggatctgccgggatacggtcgcagcagcggctttggcgcgctgactcttcagcagatgacagaggcggtgctggctcgcgcgccggacagcgccatctggctgggctggagtctgggcgggctggtggcaagccaggcggcgctcagcgccccgcagcgtgttcaggcgctggtaacggtcgcgtcttccccttgcttctgcgccgaagatgactggccgggtatcaagcctgaggtgctgtccggctttcagcgtcagctgagcgaggattttcaacgcaccgtggaacgtttcctggcgctgcaaaccctgggcaccgaaacggcccgtgcagatgcccgcaaactgaaaagcgccgtgctggcgctgccgatgccaggcgaaaccgtgcttaacggcgggctggagatcctcaaaaccgccgatctgcgcgcgccgctggcttcgctgaagcagcctttcctgcgcctgtacggtcggcttgatggcctggtgccacgcaaaatcgtggcgaggctggacgaggcgtggcccgccagccagtcggtgatcttcccgaaagccgcccatgcgccctttatttctcacccggaagacttttgtcaggcgctgctcgattttaaggcctcgctggcgtgatccctctccggcgtgtggcgaaatagtcaactggcgttaatacttaaggatgtcactgcggctttgttggtgaaaagcgtaatgacctaagaaccacaaccttaaaggagttaagcctatgaaacttgctaccggtattgtcgcgtctctggttattggatcgctgtcatttggcgtgcttgcagcagaagagttgcagaaagataaagtcaaagagatgaacctgaccaaaattggcacagtgaccacctctgacaccactgcgccgatggatgcgaaagcggaaatcgtgaagaaagccgatgagctgggcgggaaatattatgttgtgaccagcggtgataaaacgggcaaagacatccacgctaccgcagacgtgtataaataacagcagcaggcggatccccgatccgcctgtctgtcagccaggcatccaccactcccgcagacaggcttttccttccggacactgacggcactgcccgctcagacagccgccggactcttcctgaacgcgccggacttttcccagcgcctccatccggctcagcatcgcttccaccatcgacagcggtgtatgcagcgcagcgctcagggcgctggcctccattttgccgtgcagggccagcatatcgcggatctcaaacagtgaggccatggcgtgtctccttagtgacagtcgctgccggtgctggcttcgcagcagcgggcaagctgtttacgcgtcgccagcagatcgacgttcacccggcttctggcgcgacgcaggccgccaatcaccagcacgttaaacaggatcaccgcgaggatgcagaccaggctatagtgcgggtgctggctaaaggtggtcgtctgataaaacaccgttgagagcgaataagcgatattcagcccccagaggatcgagaagcccatccagccgcggctcgcttcgcgagcgatggcccccatcaccgaaatacaggggatgtagagcagcacgaagatcagatagctgtaggcggcggcagggctgccaaacttctcgctcatcacgcccatggtgccggtggccatttcgccgtcgcctttgctggcttcgatcggattagccagcgtgctcaggcttaaggtttccaccaggctttgccaggtttcttgcgcggcgcccagcagttcgtccgtcaggctgaactgcgcggcatcaaagggcgcgtcctgaatgttttcggcggtgtagagggtgtttaatgtcccgaccaccacttcttttgccatcgcgccggtaaacaggccgacggtggcctgccagtgatcgccctgcacgccgataggttccagcagcggcgtgaacacgcggctgactgaggcgagcgccgaatcgttaatactggtagccgcctggccgccgagggtgaagctgttcagggcgctgaggaaaatactgaccaccacaatcaccttacccgcgcgcagcacaaagcctttcagacgctgccaggtttgcagcagcaggcttttcagatgcgggacgtgatacaccggtagctccatcacaaaaggcgaggcttcgccgcgcataatggtgtgcttgagcatcaggccggtgagaatagccatcacgatccccagcacatagagcgagaacaccgccagcgcaccctgctgcccgaagaaggctgaggcgaacaccgcgaagatcgccagccgcgcgccgcaggacataaagggtgccatcatgatggtcatcaggcgctcacgcggcgcatccagcgtgcgggcgcccattaccgacggcacattacagccaaagccgacaatcagcggcacaaaggatttgcccggtagccccagcgactgcatcaggcgatccatcacaaaggccgcgcgcgccatgtagccggagtcttcaaggaatgacagaaacaggtacatcatgccgatctgcggcaccagcggcagcacggtgttgataccgccgcccagcccctgggcaaggaaaatggtcagccagtccgggaaatgcagcgtgtaaccaatccactgaataccgtgaatgaaaatggccacggaaccggcgtcaaagatcggcgccagcgcgccgccgatgttaatggccagcacaaacatcacgtacatcaccagcaggaagatcggcagcccgagcagacggttgaggacgatcttatccatggcggcggtaaagcgccccggctccgccgttaacgtgttgctcaccgcatcgcaaatggccgcgatggtctggtaacgggcgtcggcgatgtgcagggcaggatcgtccatctcctctttcagacgcgccagcgcctgcggcagatgctgcgccgcatcgcccgcgtagccgcggctgtagatatcgccttccagcatctgcaacgccagccagcgacgctgttgttccggcatctgtgtatccatggtttccgccagcatggcggcttcccgcagcaggggacgcgcataatgcaccaggctgatagcctgattctgctggtggcggtcaatcgccagcttaagggcgtcgatgccgcgcccgcgcgttgataccagcggcaccaccgggcaacccaggcgggcggacagggcatcgatgtcgatgcggatctgctgtttctcggcaatgtcgagcatgttaagcgccacgatgcagggaatgcccagctccagcagctgtagcgtcaggtagagattacgctccagatttgacgcatccaccacgttgatcagcatgtccgcctcgccgctcagaatgtagtggcaggcgatctgttcatcgagggaggtttgcgatgaaatggtggtcagagaataggtgccaggcagatccaccagggttaccgcgtggtcagtggtggagaacagcccttctttacgctccaccgtgacgcccgcccagttaccgacacgctgacgcgcgccggtaagctgattaaataaagttgtcttgccggaattaggattgccaattaaaccgagggttaattttttcatagtattgctgcgctctgtgagtcagtcgcttattaacgggataccgcttccacttctaataacgccagatctttttttcgtaataccaggctgacccgacgggtttcaatatgtacagggtcaccgaagggcgcgacgcgcaccacgttaaatgacgagcccggcagcatgccaagcgaaagcagtttctgacggtaagccgcgctgatttcaggggcgaaaccggtaattttccacgcgctgtcaggtgagaatgccataaggacctacttaattttgcaaatcagggtagtgtgccgggcgtcgtcaacattcaggaaaagcggaataagcgaccccggcgtcggtgacaaaataatcaactgaaagaatggtaatgagaatggtttttatcatcaacggataaaatgtgtgtgaatgttatattgacgattaatatgcgggacttttgatttagctcaaaaataagcgcggaaatgattttagttaaatggaaccagaattaacgcattgtgttaataatgtgaaaaatagtgatctgttaagttttattaattatttaaagttaattccctctcccgcaggagagggcgaaaaaaagattaacgttttttacccatggccgccgccagcgcatccatcatcgcgctgttgccggatggctgagcatcacgaccgcgtggttttgccgccccgcgcgctgccgggcggctggcctgttcgcgctgcgggccactgccgcgacgggaactggtttcgcctggctgttcgtcaagacgcatggtcagggcgatacgttttcgcggcagatcgacttccatcaccttcactttgacgatatcaccggctttcaccacgctgtgcggatcgtcgacaaacttgttggacagcgaggagatatgcaccaggccgtcctgatgcacgccgatgtccacgaatgcgccaaagttggtgacgttggtcaccgcgccttcaaggatcatgcctggcagcaggtcgttcatggtttccacgccctcggcgaaggtcgcggttttgaattccggacgcggatcgcggcctggtttttccagctctttgatgatgtcggtcaccgtcggcacgccgaaacgctcatcggtgaagtccgaggctttcagctgacgcagctcgttgccgttacccatcagatcgcgcaatgactgctctgtggcggccagaatgcgctccaccaccggataggcttccgggtgcaccgttgacgcatccagcgggttatcgccgtggttaatacgcaggaagcccgcgcactgctcgaaggctttcggccccaaacggctcaccttcagcaactgctggcggttctggaactgcccgttctcatcgcgccaggcgacaatattctgcgccatcatgcgggttaaacccgccacgcgggttaacagcggtacggaggcggtattcagatcgacgcccacggcgtttacgcagtcttccaccaccgcatcgagcttacgcgccagctgtgactggctgacgtcgtgctggtactggccgacgccgatggatttcggatcgattttcaccagctccgccagcggatcctgtaaacgacgggcgatagacaccgcgccacggatggagacatccagatccgggaactccagcgccgccagttctgaggcggaatagacggatgcgcccgcttcgctgacgatcactttttgcgccgtgactttcgggaactgcttttgcacgtcgaggaagaagcgctcggtttcgcgggaagcggtaccgttaccgatggccaccagctcaacgttatgtttttcgcacagcgtggcgaccactaccgccgctttcgcagcctggccggtgtgcggatagatggtgtcggtcgccaccagcttgccggtgccgtcaaccaccgccactttcacgccggtgcgcaggccgggatcgagacccatggtggcgcgcagacccgcaggggccgccatcagcagatcgtgcaggttacgggcgaacacgttaatggcttcgtcttcggcgcgctcacgcacggtgcccattaattccgtttcgaggtgcatcagcaccttgatgcgccacgtccagctcaccacgccacgccgccagctgtcggcaggggcgttgttcaggcgcaggccgagatggtcgatgataatctgttcgcaatggctctctttgggcggctcatcaaactgcggatcggcgttcagcgccagttgcagaatgccttcattgcggccacggaacatcgccagcgctcggtgtgacggcacgctgctaataggttcgtgatgatcgaaatagtcgcggaatttcgcgccttcttcctctttgccgctaatcaccgtcgccaccaggtgcgcgttcttccacaggtagtcacgcactttcgccagcagcgccgcgtcttccgcaaagcgctccatcagaatataacgcgcgccatccagcgcggctttggtgtcagccacgcctttatccgcatcgacgaatttcgcggcttcagtttccgggtgatgggacggatccttccacagcagatcggcgagcggttcgagtcccgcttcaatggcgatttgcccgcgcgtacgtcgcttaggcttatagggcagatagagatcttcgagttcggttttgctcagcgtactgttgatggccccggccagctcgtcggtcagcttgccctgttcgccgatggatttgaggatcgcctggcgtctctcttccagttcgcgcaggtagccaagacgggtttcgagctgacgtaattgcgtgtcgtccagaccgccggtgacttctttacgataacgtgcaatgaacggcacggtgttcccttcatcaagcaggcgaacggcagattctacctgttcagctctcgcctgaagttcacccgcaataatgcggcagagcgaattattcatcatttcaatatcatcttctgagcaaaaacagccgatagttatacggattgaggcagcaaaatgccagccgtaacgggcggcttagggattattctggcgggctattttacataggtgatctcattcacataccaggtggcttcaccgcccggcgtctgcaccacggcgacgtcgccaacctctttcttcagcagcgcgcgcgccatcggcgagtcgatggagatgtaatccttttgaccaaaaatttcatcgtagccgacaatgcggaaacggcgggtatcgccctcgtcgttctcaatttccacccaggcgccaaaaaagactttgccttcctgctgcggggagtaatctacgatacgcagattttcgaggcatttagtgagatagcgcacccggcggtcgatctcgcgcagccgtttcttattatactggtagtcggcgttttcactgcggtcgcccagacttgccgcccaggtcacttttttggtgacttcggggcgctcctgacgccagagataatccatttcctgcttgagtttgtcgtaaccctcacgggtaatcaggggcgttttcattttccatgccttattctgtgagcaaatgtacagataacttgctgttaaatatgctttgtaacaatttcgactagaattcataccagaattaactggtggtgggcgcacacttttttagaatacgctttcaagattgtccgaacctttgggagtacaaacaatgcaagagaattataagattctggtcgtcgatgacgatatgcgcctgcgtgcgctgcttgaacgttatctcaccgagcaaggcttccaggttcgcagcgtcgccaacgcagaacagatggatcgcctgttaacccgtgaatccttccacctgatggtgctcgacttaatgttacctggtgaagatggtttgtccatctgccgccgtctgcgtagccagagcaacccgatgccgatcattatggtcacggcgaaaggtgaagaagttgaccgtatcgtgggcctcgaaattggcgctgacgactacattccgaaacccttcaacccgcgcgagctgctggcccgtatccgcgccgtgctgcgtcgtcaggcgaatgagctgccgggcgcgccctctcaggaagaagcggttatcgcctttggtaagtttaagcttaacctcggcacccgcgaaatgttccgcgaagatgagccgatgccgctgaccagcggtgaatttgccgtgctgaaagcgctggtcagtcatccgcgcgagccgctgtcccgcgataagctgatgaacctggcccgtggccgcgaatactccgcgatggagcgttccatcgacgtacagatctcccgcctgcgccgcatggtggaagaggatccggcgcacccgcgctatattcagaccgtctggggtctgggctacgtctttgtgccggacggcgctaaagcatgaggcgaatgcgcttctcgccgcgaagctcgtttgcccgcacgctgttactgatcgtcaccctgctgttcgtcagcctggtgacgacctatctggtggtgctgaacttcgcgatcctgccgagcctccagcagtttaataaggtcctcgcttacgaagtccgtatgctgatgaccgataaactgcaactggaggacggcacgcaactggtggttccccctgcgtttcgccgggagatctaccgcgaactgggcatttcgctctactccaacgaggccgctgaagacgcgggcctgcgttgggcgcaacactacgaattcttaagccatcagatggcgcagcagctgggcggcccgacggaagtgcgcgtcgaggtcaacaaaagctcgcccgtcgtgtggctcaaaacctggctgtcgcccaatatctgggtgcgcgtaccgctcacggaaattcatcagggcgatttctccccgctgttccgctatacgctggctattatgctgatggcgataggcggcgcatggctgtttatccgtatccagaaccggccgctggtggatctggaacatgccgcgcttaaagtggggaaagggcaaattccgcagccgctgcgcgaatatggcgcgtctgaggtgcgctccgtgacccgcgccttcaaccagatggcggcgggcgtaaaacagctggccgatgaccgtacgctgttaatggcgggcgtcagccacgatctgcgtacgccgctgacccgcattcgcctcgccacggaaatgatggccgaagaagacggctatctcgcggaatccatcaataaagacatcgaagagtgcaacgccattatcgagcagtttattgattacctgcgtaccggccaggaaatgccgatggagatcgccgatctcaattcggtactgggcgaagtggtggcggctgaaagcggctatgagcgtgaaatcgaaacggcgatgcacccggatgagatcctggtgcgtatgcatccgctctccattaagcgtgccgtggcgaatatggtggttaacgccgcccgctatggcaacggctggatcaaagtcagcagcggtaccgagccgcatcgcgcctggttccaggtggaggacgacggtccggggatcaaaccggagcagcgtaagcacctgttccagccttttgtgcggggcgacagcgcgcgcagcaccagcggtacaggcttaggcctggcgattgtgcagcgtattgtcgataaccataacggtctgctggagctgggcacgagcgagcggggcgggttatgcatacgcgcctggctgccggttccggtgacgcgtgtcgcaagtcaggtgaaagagagttaagcgcgatgaaacggtaggcccggcaggcaacgcgccgccgggcagctaacaggcaggattacagcttcggcccggcactcaccagcgccgcacccgccggggtatcggtatacttctcgaaattactgataaacagtttcgccagcgcttcggctttctcctgccactgttccggtgacgcataagtattgcgcggatcgaggatcgcggtgtccacgcccggcaacgtcgtcgggatcgccagattaaacatcggcagcgtaaaggtttccgcctgatccagcgaaccattcagaatggcgtcaataatggcgcgcgtatctttaatggagatgcgcttgccggtgccgttccagccggtattcaccagataagcctgcgcgcccgccgcctgcatgcgtttcaccagcacttcggcgtactgcgtcgggtgcagcgacaggaaagccgcgccaaagcaggcggagaaggtcggggtcggctcggtgacgccgcgctcggtgcccgccagcttggcggtgaaacccgacaggaaatggtactgcgtctggttagccgacagccgcgacaccggcggcagcacgccgaaagcatcggcggtgaggaagatcaccttggtggcatgtccggctttggacaccggcttgacgatattatcaatgtgatagatcgggtaagagacgcgggtgttctcggttttggaaccatcgtcataatcgacagagccgtctgcgcgcacggtgacgttttccagcagcgcatcgcggcgaatggcgtgaaaaatatccggctcggcctcttcggacagcttgatcgtcttggcgtagcagccgccttcgaagttaaacacgccgtcatcatcccagccgtgttcgtcatcgccgatcagacggcgtttcggatcggtggagagggtggttttaccggtgccggacagaccaaagaacaccgccacatcgcctttttcaccgacgtttgccgaacagtgcatggaagcgatacccttcagcggcagcaggtagttcatgatcgagaacatcccttttttcatttcgccgccgtaccaggtgccgccgatcagctgaatgcgttcggtcagattaaaggccacgaaattctcggagttcagaccctgctctttccactgtgggttagtgcacttcgcgccgttcatgacgataaagtccggcgtaaagcccgccagctcttcttccgtcgggcggataaacatgtttttgacgaaatgggcctgccaggcgacttcggtaataaagcgcaccgacagacgggtgtcagcgttcgcgccgcaaaaggcatcaacaataaacagccgcttgccggagagttgacgggtaaccaggcctttcagatgctgccaggtttccggggagagcggtttattgtcgttcttgcctttgcctttatcggaccaccacacggtatcgcgggtggtgtcatcgcgaacaatgtatttatccttcggcgaacggccggtgaaaataccggtgtcgacggcgatagcaccagaatttgtcagcacaccgcgctcgtatccttccagatctggattgagctcttcctgatacagcgtgtcgtaatcagggttgtggacaatattcttaacgtcgtggataccataagcctcgagatcctgcggggttaaatcgttaacgcgcatgtcactactccttagctaaatgtactacctgagattgtagggttgttataggggttttaaccgcgacggggctcatagatttacgtatcaggaaaatctcactatatagggttacacccgtcacctggcgagacgaattatggatgttttgctttgagtcagggaggaaacgttacgcaatcgggcttttttagaggattagtcggcggctttgtgagtgtaatcgcattcatgaaaggaaattacgtaactgtttcatgaagatttaaggcgcgccgccgggcggcgacgcgcgagtcaggattaatgcacctgcggatccgcaggggaggcgttattgcggatttccgcaatatccatcgaattgaacagatagtgattaccgcagtaatcgcagtgcatgtcgatttcgccttcttccgccaggatgctgtcgatttcttcatccggcagggtacgcagcgccccggcgcaacgctcgcgggagcaggtgcacttaaacaccacgtcctgcggatcgtagagggtcacttcctcttcgtggtacagacgccacagcacgtcgttggcgggcagcgtggtcagctcttccagcttgatggtatcggtcagcgtcgccagatgttcgaagtcattggcctgggtatcctgcgccggcaggacctgcaacagcataccgcccgccgccgctttaccgtcgaccacgccggtgcgaatgaacagacgcgtcggcagctgctcagaacgcatgaagtaatcttccaggcattcggccagcgtatcgccttccagaccgacaacgccctgatagcgttcgccttcttccggcgcaatggtgatcaccagataaccgttgccgataagggttttcagatcggcattgtcaggcacgtcgccctgcacgcgcgcgacgccgcgcatttcctggcggttgttgccattgatcacggcgaggctcatcgggccatcgccctgcaactgcacggtgatatcaccggcgaatttcagggtggcagtcagtaaacttgtcgcgaccagcaactcaccgaggatcattttcaccggctgcgggtaatcatgattttcaaggatatgttgcaggctcccggataccgtcaccagttcgccgcgaacggcatagttttcaaacaggtagcggtgcaattggtcgtgttgggccatagtcatctcgtcttagggtgaagattactctttttcaccgaatttaaattttatcaggtcgcggcgttctttcttatccggacggcgatcggggtgcggcatggtgagcgcgttaagtttacgggcctcggccattttctcgcgtttttcaacgctttccgccgtttcttcatacaacgccaccgcctcactcgccggacggcgttgttcggtaatggcgctcaccactaccgtgcgttcgtcatttccctgacgcagcgtcagcatggcattcagctcaacaatcttactcggtttggtgcgctgtccgttgtagtgcactttgccgccttcgatcatctcacgtgccagcgcgcgggttttgtaaaagcgtgccgcccagagccatttatcaaggcggacctgctgtgcgggtttctctttcatcgcgtctccttcacgccgagcgcggggatcaaacggcggtagtcattcagccccggatggcgctgatattgcttttcagcgatcccggaatccggattcgtaatgccgaggcagtagcgaataccgaattgtgccgccgcatcaaggatgggttcgctgtcatccacaaacagggtgcgttccggatcaagcccggtctcctgctgtacggcttgccataatcgctgatcctctttcggatagctaaatgtgtgggtggaaagtaataaatcaaggtgtgaacccaggcccgtatgctcaagcttcaccgccaggttatgcgggtgcgcattggtcagtaaaatacggcgtttaccacaggctttcagcgcatccagaaacggcacggtgtcttcacgcaataccgcccgcgcgccctgcgcggtggtcatggcgcaaatatccagcccgaggcgttcactccagtaatccagacagtaccagtttagcgtatgctgcacggcatgatattgctggccgatatacgcctgcgcttcctgcggcgtgatgccccgctgtgcggcataggtttccggcaccagtttttgccagaaatagttatcaaacgccagatcgagcagggtgccgtccatgtccagcaaaacggtatccacgttttgccagtcaatatcaatatgcatagaacactccggacagaaggaaaattcggcgcgggctgcaaccaaagcccgcgccgaatattatcagataatgttgtccggggcggagatcagcgtcgggttgaagcagctgtcatagtactgctgaatgtcggccaggcgggtgcgatggcgctgatagcggcgcagggcctgaatgccgttatacaggctgcaaaggatcagcgccgccagcagcagggtggtcgcggcataacgccacagtccggcgctgtcgggcatacggtgcaggctgatgtggcgggtgccgttggcgtcggtataaatattggtgatgatcccttcggcgctgaacggcgtctgcatcagcatttgcgccagccgctgaaactctccccactgatcctgcgccggatagtcatacagcgcgacaggcggccacggctgatccaccagctcgctgccttcatcgctggcaatcacaaagccgccaggcgccgggctgttcagcgcctgcgctgcacgagcggtttcacgggtaataaagggcgcggtggaggtgtccaccagattatccagcgattcggcgctgaccgggcgcagcagcacgttcacgccgctgagtttaccggtgctggcgcgacgggtcagcgcctcccagtctttggtattgccgaggttaaccagcgcgtttttaagacgcagacactcatcttcggcggcgcacagatcctgggttttcagcacgatatcggcaaaatcatccagcaacaccatgccggatttttctatggccgaacgcagcgcggcgctgacgcgggaatcttcttctgtctggggatgcagctggcggttaaccgcctgaatcagcgcgctggctttattaacggtatcggattccggcagcggcaggggcggcgcatcgttccagataatctgcgagcagtcgaacggtgtaaacggcgacttttgctgggcgttccagttgcctgacgcatggatgctgcacataccggtgccgcgcaggctcagggtatctcccacgcgcaccgccgccttttccagctcgttcacgctggtcgcttcaatggtctgcgcgcctttcatccatgacacggtaaatttgatgggcatatccagcggcacccagaccagcagcatcaccagcacgatcagcgcgcctgccgcgataatggcgctgcgcagccagtgctgaaccgggaaatgcgtggcttcgtcatgcagggataaaaagcgcccctggcgcactacatggcggtcgagataaatatcaatgtccgtctgctggcctaagtcctgcgcgatatagggctgccagtgcggcggataaatcagatcgataatgccgagggaaatattattgatctgctcctgatcgttctcaccaaacagcccccagcgctttggcgtgccgcgcaggcagtggatctcacgtaacgtattttttgccggcggcgcgaataatccccacaggcctgcggccagcagcatgattgccccgcctgccatccacggcacaaaaacgttaggcgtgaccaggcagaagaaaaataacaggaaagaggcgctgatcagcagggcttcccgcagcccgtccgggcggctcagggcatactcttcccgcgtttgctggcgaatattcagcagttctatctgctcgctctcttcgccacgaatggaagcctgagtggaggtttgcacttccagcgagtagccgcgcgtctcctggatgtattcgctcagggtatggccgttgagggaaatgaccagcgggagggtgtcggtgtggatcagttccaccgcgttttcatcggtgatgtactgttcccagaacggcggcaaatgaacttctaccgcatcaaggtagtagcgccatttattgagatcgtcagtgttgatgccgtatcgggtgatcgcgtgcgtcacggaaaaaaccgtgttgctttgcgtatttaacgccatcgccaccggcggcgtggtcgcaccggtcgggccggggacatccaggatacgggatagcgaatcgaggtaactttcaaccgcgctgcgctcatcggcggttaatttacgcgtggcggcatcagcaaaaacctgaagatttggtagccggtagaggcgcttcgtccgtcgcctgaaaaaccaccatgcaagaagtgcgcaggcaaggcaggcagcgaaaaaaatcaaaatggtgctcatactttccccatcttactttttttacagaggtgtggtcagtagcaccctttccaaaaaaaacgtcatcacatggctggtttcgggcaagtataaaactgaattcttttaagcgcataccagcgcgcaggatagtaacaaaacacgcgctgcatgcaatatcagcaaattcctaatctcaattcaagctcttgacttttttaatgaaatgatgaatgtactagttgacgttacaaatatgtaaattgagcgcgaatgccgttgcccaaactgctcgctataccgcacaataaacagagttttcactgtaaagaccccatcataatgagtaaatcattgcaaaaacccaccattcttaacgtcgaaaccgtcgctaaatcacggttatttaacgttgaaagcgtggatctggaattcagcaacggcgagcgtcgtgtttatgagcgcatgcgcccgtcaacgcgcgaagccgtaatgattgtgcccatcgtcgatgaccatctgattttgatccgtgaatatgccgtggggatcgaagcctatgaactgggcttttcgaaagggcttatcgatccgggcgaaagcgtgtatgaagccgcgaaccgcgagttaaaagaggaagtgggttttggcgcgcataacctgacgtttctgaagaaactgagcatggccccgtcctatttctccagcaaaatgaatatcgtggtggcagaagatctctatccggagtcgctgcaaggggatgagcctgaaccgctgccgcaggtgcgctggccgctggcccatctgatggatctgcttgaagatcccgatttcaatgaagcacgcaatgtcagcgcgcttttcctggtgcgggaatggctgaaagggcagggcaggctgtagttttatggccctctcccggcgggagagggctttaggatcagaacagttcgtgcgtctcgccgttatcaataatcgtcgttcccacctcatgtaccgcctgctgtgtcggctgcgtaccttcgatgaaatactcctgacgactgttgccgccgttggccaactgaccggtgctgcggtcgatattgacggttacaatgcccggcggcggcgtcagcggttcttccggtacgccttccagcgcgtgtttcataaaggcatcccaggcaggctgggcgctcttcgcaccgccttcatagcctgagatctgatctttaatcgcccccgaggcggtggtgcgccccagatcccggcgatggtcgtcaaagccgatccataccgaggtgaccgcgccagggccgtagccggagaaccacgcatctttcgagctgttggtggtaccggttttgccgccgatatcattacgtttcagatcgcggcccgcacgccagccggtgccctgccagcccggttcgccaaagatattgctgttcagcgcgcttttgattaagaacgccagcggagtattgatgacgtgcggcgcgtactcctgcgccccggtttgcgccaccagcgcctgattagcctgtcccagctgcggcatcggtacgacggcgttctgctgctcctgcgagcgggcgacgtcttccacgtctttgttctccagcacgccggatttctgcgtttcgccgtaaataaccggaatatcgcaatccgcacaggcgatcttcggacgggcttcaaagagtacgccgccctgatcgttttcgatcttgctgatgaaatacggatccaccaggaagccgccgttcgccatcaccgcataaccgcgcgccacctgaagcggcgtaaaggacgccgatcccagtgccagcgattcggtatgcacgatgttctgcgccgggaagccgaagcgctgcaaatactctgccgcgtaatccacgcccatggcgcgcatcgcacgcaccatcaccacgtttttcgactggcccaggccctgacgcaaacggatcggcccggcgtattccgcaggggagttcttcggctgccagtcagagcctgcgcccgcatcccagcgggaaatcggcacgtcgttgagaatactcgccagcgtcagccctttgtccatcgccgccgtgtagaggaatggcttgatgtttgagcccacctgacgcagcgcctgggtggcgcggttaaatttgctctgattgaaatcgaagccgccgaccagcgctatcaccgcgccgttttgcgggttgatggacaccaacgccgagttgacgtccggcacctgcgccagccaccaggcatcctcaacctgacgcacccagatttgctgtccggcctgcaccacatcggtgactttgcgcggcgtagcgccctgcgcggtatccgaacggtaaggacgcgcccagcgcatgccttccatacgcagcgacactgaggtgccatctgccagcattgccgtcgcttcctgcaggctggtgcccgtgaccacggcaggcaacagcggcccgtaggtcggcagcgcttttaacgtgcgggtgattttctgggtatcccatgcgctttcacccagcttccataacacgttcgacgggccgcgatagccgtggcgcatgtcgtaatccagcacgttgttacgtaccgcctgctgagcggcctgctgcatctgacgcgtgattgtagtgtaaacgcggtagccatcttcataggctttctcgccatagcgggacaccatctcctggcgcaccatctctgacagataaggcgctgagaaggcgatttccggcgcgtgataattggcgtcaatcgcctcgccgcgcgcctgatcgtactccgtctgcgagatatacccttcgctgagcatacgcgacagcaccacatttcgacggctggtcgcacgttccagcgagtagagcgggttgaaggtcgacggcgctttgggcagaccggcgatcacggcgatttcgctcagcgtcagctgatcgactgacttaccgaaataaacctgcgcggcagagcccacgccgtaggcgcggtaaccgaggtaaattttgttgagataaagttcgaggatctcgtctttattcatcagctgttcgatgcggatggcgagaaacacttcctttattttacgcatcagggtgcgttcggggctcaagtagaagtttcgcgccagctgctgcgtgatggtgctcgcgccctgcgaggcatgaccggagaaaagcgccacgcttgccgcacggaaaatccccacgggatcgacaccatgatgctcataaaaacggctgtcttctgtcgcaataaacgctttcaccatcaccggcgggatctggtttaaggtcagcgggatgcgccgtttttcaccgtactgagcgataagctcgccgtcagcgctgtaaacctgcatcgggatttgcaaacgcacatctctgagcgtggcgacatcagggagttgcggctcaacatatttgtataagccatagatcgagcctgctcccagcagaatgcaacagactgcaaggatcaataaatactttacgaacttcaccggagatttcccatttagttttatctgggcagtttataaacaaccgcgcggtagtataaaggcaagcctgatgcattgatagggtcgtcactttggcgaccgataaggagatcgctgatgatggcattcgggcactggcaaataggactgcatattcaacagagtggcgtgtatggcgttgcgctgatccgcgaaaagacgcagtgggcgctacgccgctggtggcaggtgccgctggccgacgatgtcgtcgtcgacgggcaaatccggcagttcgatgtgctttcacagacgctgttgccctggagcaaaacgctgccgcgccgccaccatatccggctcgcttttccggcgggacgtaccctgcaaaagacctttccccgtccggcgatgcgccttggcgaacgcgaacggctgtcgtggatgacgggaagcctcgcgcgggaactggacatggcgggggaagatttacgcttcgactacagtgaagacacgctgcaggacgcctaccgcgtgacggcggcgcaacaaaaagagattgccgacgtgcttgaactggcgcggtcgctgcgtctgcacgttgccgccatcacgcctgatgcctgcgccctgcaacggctgatcccgctgctcgcgccgcctgcccgctggctgatttggcgcgatcccggccagtggctgtgggccacgcgggagcgctggggacgatatccggcgcagggcattgattcgccgcaagcgctggcgcttaagctgggcctggagccagcgctggggcaggtgtgcgaagcggcggcgggctttgatgcctggtgcgctgtggcccatcgccagccgcctttaccggtaaacggcgacgcctgggcgatcgccattggcctggcgctgggtgaggcgcgctgagcatgtacatggtcaatcttctgccctggcgtttacagcgtcagcggcgacgcaatcgcttctggtgcgcggtctataccgctaccgtgctgatcctgctgctggtgacgctggccggacgacagggtatccaggcggagcagcggattaactttcttatagaggacgccgacgccacgctgtttgcggcgctgagccaacgccacgcagagcggacacaggcgcagcagcgctggcagcagcaggcgaaacgcttacagcagcgtgcagcaacgcgggaatggcaacgcagcctgacgcagctggcagaacagatgccggataaggcctggctgacgcagttgcgctatcagcagggaaaacttgcactggcaggcgtcgccgcctcgcttgcggccttatcccggctcgacgatgcgctcggccagatccccggctttcatcccggtactgccggggcgaccacccgcgatgcgcagggccgctggcagtttcagcaccaattaattgaggacgcagcccatgcagcggtgccttgatttctggtacggcttaaccgggcggggccgggtggcgctgtggctgatgctgacgtgtggccttgccgtctgcctgtggtggatagccattcgcccgccggaaaacaggctggcgcaactgaagagcgatcgcgccgcccggcaactgacgttacgccagcattatctgaaaacgtacgcgctgcgcccgccggaggggctgacggaaagcgagcctgcgcgggctttttcgccccttgattttgcgcccccgcacgccaccctgacgcgctggcagcccgccctgcatggcggtgagctggaactggcggcgcagtgggcgcaggcggttgcgacttttgcacgcctggcggagtacgacatggtggtccggggttttacgctggagccggaaggcgggcagttacgcttcactctgcaactggaggcggccaatgatccttaaacgctggatgctggcggcgaccgctttgatctcgcttaccgggatgcgggatccatttttgccgccgccggacctttgtcagacggcgcagctgacccaatggcgctatcagggctatgtcgcgatgcgggggcgcgccatgggcatcctgcgcgatggcagcggcaaatggctgcgggtgagcacgggcgatcgcttaccgaccggatggcaggtgggagagatcacagacctcgagatgcaaatttttaccgcggcagactgcgagccgcagcagtggcgctggacacgacagggagatcagcatgaaacaatggacaggaataatcatgatgtgcagcatcctgaccgcaagggcggaagcgccgaagccggtcacgctgatggtggacgacgtgccggtagtgcaggtgctgcaaagcctggcgcagcaggagaagcataacctggtggtctcgcccgatgtcagcggtacgctctcgctgcatcttattaatgtgccctggaaacaggcgctggaaacagttatcgccagcacgggtctgaccatgcagcggcagggcactattctgcatgtgcattcacaggcctggcagcagcaaaaacaggccagtctggatgccgggcgggaaaagcagcggctgaacctgccgctgcaggaccagagcatcgtactgcgctatgccgatgcgggcgagctggccgctgcgggtgagaagctgctcagcgccagaggcacggtgacggtagacaaacgtaccaatcgccttcttgtgcgtgataatgccgacacgctccgtacctttacccgctgggttgagcaaatggatctgccggtggcgcaggtagagcttgaagcgcacatcgtgactattaatgaaaaaagcctgcgcgaactgggcgtgaaatgggatctggccgaagcgcccgccgatgcggtggcaaaagtcggtcatatgacggccttaagcggcgatctgtcggtggccaacgccaccacgcgggtcggttttaatatcgggcgcatcgacgggcggatgctgggcattgagctgtcggcgctggagcaggagcagaagctcgatatcatcgccagcccgcgtctgctggcgtcccatttgcaacccgccagcatcaaacagggcagcgagatcccctaccaggtgtccagcggcgacagcggcgccacctcggttgaatttaaagaagcggtactcggcatggaagtcacccccacggtgctgccggatgggcgagtgcgtctgaagctgcatatcagccagaacatgcccggacaggtcctgcagcaggcggatggcgaaaccctggctatcgataaacaggaaatcgaaacgcaggtcgaagtcaaaagcggcgacacgctggcgctgggcggcatttttcagcataaaaagaaaaccgcccgcgataaggtccctttacttgccagcgtcccctggctgggacagctgtttcgtcatgacggaaaagataatgaaaggcgggaactggtggtgtttatcaccccccggctggtgccgctgcgttagcgacaggtggccgccatgccgcggaaacgttgcctgcgggtggcaacaatggtgcgtatgatatgcaagaaagttgatggtttttgcactgaactgaactcaggtgtttgacgtgggagatgaattagcttacaaggagtaccgatttgagcgtcagatagtcctgacacacctcaattgacctctgtgaaggattggtgatttattcagttgccaaacaagccggagtattgagataattttcagtctgattctcgaactcaccatatgaggtttcagttcatgtcctgcggcgttgtgtgtctgcgaagcgggtttatcattaacgaatagtcttagtagtaccgaaaaaatggcagagaaacgcaatatctttctggttgggcctatgggtgccggcaaaagcactattgggcgtcagttagctcaacaactcaatatggaattttacgattctgatcaagagattgagaaacgaaccggagctgatgtgggctgggtcttcgatgtagaaggtgaagatggtttccgcgatcgcgaagaaaaagtcatcaatgagctgactgaaaaacagggtattgtgctggcaactggcggcggctctgtgaaatcacgcgaaacccgtaatcgtctctccgcccgtggcgtagtggtttatctggaaaccactatcgaaaagcaattagctcgtactcaacgtgacaaaaaacgcccactgttacaagtggatacaccaccgcgtgaagtactggaagcgctggcgaacgaacgcaatccgctgtacgaagagattgccgacgtcaccattcgcaccgacgaccagagcgctaaagtggtcgcaaaccagattattaatatgctggaaagcaactgatttctggctaaacgtaacccctcgggttttagcaactaaggtggatgtcgcgtcatggagaggataaacgtcactctcggggaacgtagttaccctatcaccatcgcggctggcttgtttaacgatccagcttccttcttgcctctgaagtccggtgatcaggtaatgctggtcactaacgagacactggctccgctgtatctcgataagatccgccgtgttcttgaacaggcgggcgtcaaggtagatagcgttgttctgcctgacggcgagcaatataaaagcctggcagtgctcgacacggtcttcaccgccttgttgcaaaaacctcatggccgcgacacgacgctggtcgccctgggcggcggtgtggtgggcgatctcaccgggtttgcggcagccagctatcagcgcggcgtccgcttcattcaggtgccgaccacgctgctttcgcaggtcgactcctccgttggcggcaaaacggcggtaaaccatcctcttggcaaaaacatgattggcgcgttctaccagcccgcttcggtggtggtggatctcgactgcttatctactttgcctgcgcgtgaactctcctctggtctggctgaagtcattaaatatggcatcattctcgaccgcgaattctttatctggctggaagacaatctggatgcattgctgcgtctggacgggccggcaatggcgtactgtattcgccgctgctgcgagttaaaagccgaagttgtggcggctgacgagcgcgaaaccggcttacgtgctttactgaacctggggcacacctttggtcatgctatcgaagctgaaatgggctacggtaactggctgcatggtgaggcggttgctgcgggtatggtgatggcggcgcgcgtggctgaacgcctcgggcagttcgaccagcaggatacacaacgtattattacgctgctcaagcgtgccggccttccggtcaacggcccgcaagagatgtcccgcgaggcttatctgcctcatatgatgcgtgacaagaaagtgctggcgggcgagatgcgtttagtgctcccgcttgccataggtaaaagtgaagttcgcggcggcgttccgcatgatgttgtacttgacgccattgcggattgccagcaagcgtaacaattagaaaggtctggccgcgccagccgtggcgttttaacttcgggcgatatgcacgtggtaagcataagcctatgagtggggtgttaaatggatgaatacaaaccagaagacgagctgaaacccgatcccagcgatcgtcgtactggtcgttcccgtcaatcttctgatcgtgacagtgaaccgcaaatcaattttgatgatgtcgatctggaagcagacgaccgtcggccttcgcgatcccgtaaaccccgtgaagacgaggagtacgaggagtatccggaagaagacgcgtctgtggatgagccgcgcgaagtgcgccgtccgcgcaatcgtaaaaaagccgccgccgcgaaacccgcttctcgtcagtacatgatgattggcctggggatcctggtgctgttgctgctaatcgtcggtatcggctccgcgctgaaatcgccggtgagcaaaaacaatggcgagcaaacggcgtccactgagaaaaatatcgatctggctggcagcagtactaccaacaatgccgccgaccaggctaacgccacgcagcctgcgccaggcgccacctctgcggagcagacggctggcaaccagcaggacgtttccctgccgccgatttcttcgaccccgacgcaggcgcaaactgccgctacgccggaaggccagcagcgtgtggaagtgcagggcgacctgaacaatgcgctgacccagccgcaaaatcaggatcagctcaataacgtggcggttaactccacgctgccgacggaaccggcgaccgtggctccgctgcgtaacggcgctgccgcaccgcgtcagaccaccgacacggcggaacgtcagacgaccccgcgcaccaccgagcgcaagcaggcggtgatcgagccgaaatcgcaaagcaaaccgcagagtaaaccgcaggctacgcagaccgcgccaaaagccgtgccggttcagccgaagcgtacggaaacggtgattgccgcaccggcgaaaacgccggcaaccaacacggcaccgaaagcgaccgccagcgtaccggctaaacctgccgcgcctgcggcgacagccaccaccacggccccggcagcgaccacgccagcgaaatccgcagcgccagccgccaccgcgggtggtaccacgggtaatgtgggcgcgttaaaatccgcgccgtcaggacactacacgttgcagttgagcagttcttccaactccaacaacctgaacgcctgggcgaaaaaagagaatctgaaaaactacgtggtttatcagacctcccgcaacggtcagccgtggtatgtgctggtgagcggtgtgtatgcctctaaagaagaagccaaacgcgccgtggcaacgctgccagccgatgtgcaggcgaaaaacccatgggcgaagccagtgcaccaggtgcaggccgatctcaaataatgattaaagcgcaggttgctgtcggagctttctccacagccggagaaggtgtaattagtcagtcagcatgaaaaagaatcgcgcttttctgaaatgggcagggggcaagtaccccctgctcgacgatatcaaaaagcacttgccggaaggcgagtgcctgattgagccgtttgtaggtgccgggtcggtatttcttaataccgacttttctcgttatatccttgccgacattaacagcgatctgattaacctctacgacatcgtgaagacccgtaccgatgagtatgtgcagagcgcgcgtgaactctttgttccgcaaaccaatcaggctgaggtgtattaccagctgcgcgctgagtttaaccagtgccacgatacgcttcgtcgcgcagtcctgttcctgtatctgaatcgtcatggctacaatggtctgtgccgctacaatttacgcggcgagttcaatgtgccttttggtcgctacaagaagccctacttcccggaagcagagctgtaccatttcgccgagaaagcgcagaacgcgtttttctactgtgaaacctatgccgacagcatggcgcgcgccaccaaagattcggtggtgtactgcgatccgccttacgcgccgctgacctccaccgcgaattttaccgcttatcacactaacagcttcagcctggaacagcaggcgcatctggcgcagttggcggaaaatctgaagaaagagcagatcacggtgctgatctctaatcacgatacgtcgttaacccgtgaatggtacagtcaggcggagatgcatttgttaaaagtgcggcgcagcataagcagtaatggcggcacacgtaaaaaggtggacgaactgctggctctgtatcgcccatgagccgtttcgcccgccgctaaaacctctaaggagatgcggatgaaacagtatttaatagccccttcgattctgtcggctgattttgcccgcctgggtgaagataccgcgaaagcgctggctgccggtggtgatgtggtgcattttgacgtgatggataaccattatgtgccgaacctgaccatgggtccgatggtgctgaaatccctgcgcaattacggcattaccgccccgattgacgtgcatctgatggtaaaaccggtcgacagactggtgccggattttgccgcggcgggcgccagcataatcacctttcatcctgaagcgtccgagcacgtggaccgcacgctgcaactgatcaaagaacacggctgtaaagccgggctggtgttgaatccggccacctccctgaactacctcgattatgtgatggacaagctggacgtgatcctgctgatgtccgtcaaccccggctttggcggtcagtcatttattccgcacacgctggataagctgcgcgaagtgcgtcgccgcattgacgcttccggccgggatattcgtctggaagtggacggcggcgtgaaggcgagcaatatccgcgatatcgccgctgccggtgctgacatgtttgtggcaggctcagccatttttgacaagccagactataagcaggtgattgatgaaatgcgcagtgaactcgcaaaggtcggtcatgaataagatgcaggatattcgtggcgtggcattcgatctcgacggcacgctggttgacagcgcgccgggcttaacccatgcggtggacatggcgctctacgcgctggaactgccgcaggcgggggaagagcgtgtgatcacctggattggcaacggcgctgatgtgctgatgcagcgggcgctgaactgggcccgtcaggagcgcgcggctttacgctcatcaatgggtaaacctgccgttgaccaggccgatattccggaagaagagcaggtgcgcatgctgcgtaaactgttcgatcgttattatgccgacgtggtggaagagggcagtttcctgttccctggcgttgaacagacgctggccgccctacaggcgcagggcctgccgctggcgctggtcactaacaaaccgacgccatttgtcgcgccgctgctggaggcgcttaatattgcccgtttcttcagcgtggtcatcggcggcgatgacgtgaaaaacaaaaaaccgcacccggagccgcttctgctggtggcggaaaagctgggcatcgaaccgcaggcgttgctctttgtcggcgattcccgcaatgatattctggcggcacgtgccgcaggctgttgctctgttggcctgacttacggctacaactacggtgaagccattacgcttagcgagccggatcacgtgttcgaccgctttaacgatttactgcccgtgctcgggctcccgcacagcgaggatcaggaagaaaatcatgactaagcccatcgtatttagtggcgcacagccttcaggtgaactgaccatcggtaactatatgggtgcgctgcgtcagtgggtaggtatgcaggatgattaccactgcatttactgcatcgttgacctgcatgccatcaccgcccgccaggatcctgaaaagctgcgtaaagctacgctcgatactctggcgctctatctggcgtgcggcatcgatccggaaaaaagcaccatcttcgtacagtcccacgtgccggagcacgcgcagctgggctgggcgctgaactgctacacctattttggcgagctgagccgcatgacccagttcaaagataaatcagcgcgctattccgaaaacatcaacgccggtctgtttgattacccggtgctgatggccgccgatattctgctctatcagaccaaccaggtgccggtgggtgaagatcagaagcagcaccttgagctgagccgcgatattgcgcagcgcttcaacgccatctacggcgacgtctttaaagtgccggaaccttttattccgaaatccggcgcgcgcgtgatgtccctgcttgagccgacgaaaaaaatgtccaagtccgatgataaccgcaacaacgttatcggcctgctggaagatccgaagtcggtcgtgaagaaaatcaaacgtgcggtaaccgactccgacgaaccggcagtcgtgcgctatgacgtgcagaacaaagcgggcgtttctaacctgctggacattctctctgccgtgaccggtaagagcatcccggaactggagcagcatttcgaaggcaaaatgtatggccacctgaagggcgaagtggcggacgcggtatccgctatgctgactgagctacaggaacgctatcaccgctaccgcaatgacgaagccttcctgcaaaaaatcatgcgcgaaggggcggagaaagccagcgcccatgccgccgtgacgctgaaaaaagtgtacgaagccattggttttgtcgcgaagccgtaacgcattcgttcagaaaaaaaccgggaaattcccggtttttttgtatcggtgcaagagtgattcagacccttactgtgctgccgccgggccgcagccgccgatgattttagaaacagaaatggccggatgcagcaggtagtcgtagctgcaattgttggctttgttctgcacgtgacctgtacaggcggagagggtagtaacagctgcaatcagcgcagtgattttaataatcttcttcattcgatcttccttgttattcatagtcatcagcatgtttttcataattgacgtggataattgcagagcgcaatatttccacggtcaattttaactgcatgattatattgaattttaaggggatctcttagtccggagccggactggtaacgtggacagaaaaatgaataaagccagacggcgctggctttatctgaagatatcaatgatttgagaaccagttaagcttatcgcgcagggcgaccacgcgaccgacaataatcagcgccgggcttgctacctgggttgccagttcccccagttcattgagcgaaccgctaaccactcgctgcttaaccgaagtaccgttttccaccagcgccaccggcatatcgctttccatgccgtgggcgatcagctgcgcctggatagtcgcggcctgattcagccccatgtaaaacaccagcgtctgtttttcggcggcaaggttggcccagtccagttccccgccggttttcagatggccggtgatcaaccgcacgctctgggcataatcacggtgggtcagcggaatgccagaataggctgaacatccggatgccgccgtgatccccggaactaccgagaagggaatgcccgcatgacacagggtttccagctcttcgccgccacgtccgaagataaagggatcgccgcctttcagacgcacgacgcgtttaccggactgcgcggcgcgcagcaggatttggttaatctcttcctgcggcacgcagtggtaaccggcgcgtttaccgacgaaaatgcggtcggcgtcgcggcgcaccagattcataatgtcgtcggagaccaggcggtcgtacaccactacatccgcctgctggatctgctgcaggccttttaaggtcagcagcccggcatcgcccggccctgcgcccaccagcaccacttcgccgcgtttatccagcggctcgttcagcagctgttcggtgacgtcgctgatggcctgagtatcgtcgttggcgagcgactgggcgaggcgatcgttgacaaagaatttttcccagaaacggcggcgctcgcccacgttatcaaagtgggttttcacgcgatcgcgcagtttacccgcgtagcccgcaagctgcccgagatgctgcggcagcacggcttcgagtttttcacgcagcagacgggccagcacgggggaggtgccgcccgaggagaccgccaccatcagcggcgaacggtcaataatggacggcatgataaaactggcttctttcggcgcatccaccacgttgcagaaaatacgccgcgcttcggcggcatcgctgacgcgctgattgacgtcgttatcgtcggtggcggcaatcaccagccaggtggtgtcgagcagcgcttcattaaaatcgccctgcgccagcgttaacatgccttcgtttgcccagacggtaaactgcggcgaaaaggccagcgcattaacggtgagccgcgcaccggcttccatcaacagtcgggctttacgttctgcgacatcgccaccgccgaccagcaggcagtcacgaccgcgtaattgacaaaagatgggaagatggtgcacgacattacctcattatttttattggcccagggtttccgtgagcgtcgctttcgccggtaccgggcgttcagcacgaggagtagcataccaataacccagtcccataaatacggcaccagataaagtattgcccagggttacccacaagaggttatgaccaattccggagagggtataggcttcgctgtgatgcccaaaccaggaaagggcgaacagcgtcatattggcaacggagtgctcgtaaccggaggcgataaacgccagcaggcaccaccagatagcgaggaattttgccgcgccttctgtgcgtaccgccatccagatcgccagacaaaccagccagttacacagtgcgcctttaaagaacagtacgcctgcgggcgcggtggttttcgccagcgccgcggtatgaaccagactggtatccagcggtaacaggctgccgccgccccagttatagagcagcgcgacgaacaccgagccaatcaggttgccgagccaggtttgcggcagaatagtccacatctgaccgtggctgatggtgcctgctttgacgccgaaggtcagaaacatggtgtgaccggtgaataattcagaaccggcaataatcaccagcgttaacgcaatcccgaaggtcgcgcccatcaccagcggacgaacgctggggtcaagcagattaccgagggtaaagatgaggataatacccagccccacgtaagcgcccgccatagcggagctgatccagaagccgagcggattttgcgccgagagccgggcaattcgcgccgcgttcgcggcacatttattgatagtgtcggtaaacatgttgattatcctttaacacgtcatcctttgggatgccgcaaaaatgatgttgtgtgaaaaattaaaaagaaaataaaaatttaaaaaaggggaggcgttgcgcctccctgaatgcttaacagcgtacctgcacttcgccatccttcacccgcgcgtcaaaatgcgcgaccgagtggctttcatcctccatgcacagcccgtcccgcagacggaaacgctgttttttcagcgggctggcgacccacagctcgccgttgtgctcggcaatcaggccgcgcgacagcacgctcgcttcaaaaaacgggtcgatattgctgatggcaaaaacttcctcgtcctgacgcgggcgaaaaatcgccacctgctgatcgttcaccagcgcgcaaacgccggtctgcggaatgatgtcagcgatgttgcagatagtgttccactggctcatacggtttcctccaccatggtcaccgggatacgctcataaggcgtggccgggcgatgctgttgacgttccgggacgatctgcacgttcggatcgcgctgcgggctgttaatgaagtgtttgaagcgcacctgcgcctgcggatcgttgacggtttcggtccactcgcagaccaccgcctcgcgcagacgggtcatttcggcttccagctgcgcgttcaggcccagcttgtcgtcaatgatcacgctcttcaggtaatcaatgccgccttccatattttccagccatggcgcggtacgggtcagcttgtcggcggtgcggatgtagaacatcatgaagcggtcgaggtatttcaccagcgtatcgcgatcaagatccgccgccagcaggtcggcgtggcgtggtttcataccgccgttaccgcagacgtacaggttccagcctttatcggtggcgatgatgcccacgtctttaccctgcgcttccgcacattcacgggtacagccggacacgccaaacttcattttgtgcggggtgcggatgcctttgtagcggttttccagctcgacgccgaagcccacgctgtcgcccacgccgtaacggcaccaggtggagccgacgcaggttttcgccatacgcagcgctttggcataggcatgaccggtttcgaagcccgcctcgataagctgacgccagatttccggcaggtcatctttctgcgccccgaacaggccgatacgctgagagccggtgattttggtgtacaggttaaattcgcgggcgatacggccgacttccatcagcccttccggggtgatttcgccgccagcagagcgcgggatcaccgagtaggtgccgtctttctggatattcgccaggaagttgtcgttggtatcctgcaaaggcgtgtgctgcggtttcaatacgtactcattccagcaggaggccagcagcgagccgacggtcggtttacagacttcacagccgtagcctttaccgtatttgtgcagcagttcgtcgaaggttttgatgccttccacgcggatcaggtggtacagctcctgacgggaaaacgcaaagtgttcgcacaggttatggttaacttcaataccctgtttcgccagctcagcgttcagcacctgggtgaccagcgggatacaaccgccgcagccggtaccggctttggtttccgctttcagcgccgccacggtatggcagcctttgttgatggcggaaatcagcatgcctttggtgacgtcgaagcaggagcagatttgcgcgctgtccggcagtttatccacgccgattgacggtttgccgctgcctgcgtgggcgggcaggatcagcgcgtccgggttttccggcagttcaatggcgttcagcaccagttgttgcaggttgccgaagtcgctggtgtcgcccaccagcaccgcgccgagcagggttttattgtccgggctgacgatcaggcgtttatagacttctttgctttcgtcgaggtacacgtagctgcgcgcgcccggcgtacggccatgcgcatcgccgataccgcctacgtccacgccgagcagtttcagcttggcgctgaggtcggcgccttcaaaggcgttggtgttgccgaggatatggtcaacggcaacctgcgccattttgtagcccggcgcgaccagaccgtatacgcggttattccagctggcgcattcgccgatggcgtagatgtccgggtcggaagtctggcaggtgtcgttaatcacgataccgccgcgtgccgcgactgccaggccgcactgggtagccagtttgtcgcgcgggcgaataccggtggagaagacgataaagtcgatttccagatcgctgccgtcggcgaagcgcatggttttgcggccttcaacgccttcctgcacgatctcctgggtgtttttgctggtgtgcacgcgcacgcccatgctttcaattttacggcgcagctgttcgccgcccatctgatcaagctgttccgccatcagcattggcgcgaactcgataacatgcgtttcaacgccgaggtttttcagcgcgcctgcggcttccagaccgagcagaccgccgccgaccaccgcgccgcgacggctgcgacgggcgcaggcttcgatggcgttcagatcttcaatggtgcggtaaacaaaacagtcctgcgtgtcagaacctttgatgggcgggatccacgggtaggagccggtcgccatgatcagtttatcgtaatagaccgtgcggcctgcgctggagtggatcactttttcctggcggttaatggtgatagcgcgctcgccgaccagcaccttaacgccgtgcttctcgtaaaatccttcccgcaccagcgacagctcttcagcggtatggtgagagaagtaggaagacaggtgaacgcgatcgtaggctttacggggttcttcacaaaaaatggtaatgtcgaactggctggcatccgctttatcgagaagatcctcaacaaagcggtggccgaccatgccgttaccgattatagcgagtttgactttgctcatttttgcctcgatttcttttctattactgcctaccttaacgattcagcaatggcgtttattgatgcaaatcaattacacctttaactactccttaatgagtagatgactgatttcaggggatttttctaagttgaggaaatgtcaggcttttcagagttgaggaaaatctgagcaaaaaacagggtttttaagaaaacgacctactccttaagatcaggaggtcatttacagggatggagtagtgtttttatgcggggaagtacagcaaaaaatgccccttcccggcaggaaaggggcgcagagattagtgtgcagttgccgttgcgccatgctggcgatgacgggtaacgaagcccagcgcaaagcacatcacgaagactaccgcgtacagcccgttggcggtgaacagtgccgcctgcgggccgctactggcaacaatcgggccggtgacgatgaaggtcagcatggtgccgatggtgccgcaggtcagaataaagttaaccagcttcggcgacgccactttcgtctgttgcgagccgagcgtgatgatggtggtgtagatcgcgctggagaagaagcccagtgccatgataaaccacgccatatggtcggtagcgctggtgatgaacaggtacatcagtaccgccgccaggcctgccagaatggtcagaatgcgctgcagatcgaagaagcgcaggatgaagctgaacgcccacatgccgaccatgtacgacatccagaaatcactcaccagtttgccctgagcgctgacgtccatgcccatgcctttcacgtattccggaacccaggcgataaagcccagctgacccaggatgtagcacatggccgcgatggacaggaacagcacgccgatgccccatttttctttcactaccggcttgtcgcccggtgccgcatgtttgcccagcgccgggaattcacaaccaatggtcagaataaagatagcgacgtacaccaggccgatacaggcgtaaacccagtaccattcgatgctgcgcgccagcaggtaagcggcgaccatcgggaaaatcatcccggccatgctgaagaaggagtcggtgaacagcaggcgcgaaccacgctggcggccttcatacatctgcgtgaccaggaaagtaccaatcgacatggtgatgccgctgaccagaccgagcacgaacatggcggcggagaacagcgccaggctgtgggtcagcatcagtccggcaacggccagaatcatcagcacaaaaccaaagcgcagctgcgttttcagcggcacgatttccatcagccaggcgttcaggaagatagagattaagatcccggcgttcaggaaggtgaaggtgttactcatactggataccggcagattaaagtattctgcgatatttcccatcaccattccggtgacgatcaccaacgcgccggtaagggcgtaggagaagaagctgatccatgtgagcttgatacggttgctgttagtcatgtctggcctgtgcatataagtgtaaagcgcgttgacagcgctgtgaacgggcagattttatgcaataaagtgatacatttaaatctttaataatgaatatgaaacttattgcagtatttattatgagatcgctcacactttaggccgctatttatcataaatttgtgaggttacaactgtttcaatttcgtaaaattaggtaaaaggctggcctgtgagctatcgcctctttagaatctatccactcgctcttttaccgctctatgtttaggaattctcatggttaaaatgactctggcggctgtcgcagctgtatttgctctttctgcaatttcccccgctgcgctggcagcaaaaggtgatccccatgttctgttgaccacgtctgccggtaacatcgaactggagctgaacagccagaaagccccggtgtccgtgcaaaacttcctcgactatgtgaacagtggtttttataacaacaccaccttccaccgcgtgatcccgggctttatggtgcagggcggcggtttcaacgagcagatgcagcagaaacagcccaatccgccgatcaaaaacgaagcggataacggcctgcgtaatacccgcggcactatctcaatggcgcgcaccgcggataaagacagcgcgaccagccagtttttcttaaacgtagcggataacgccttcctcgatcacggtcagcgcgatttcggctatgcggtattcggtaaagttgtgaaaggtatggatgtggcggacaagatttctcaggtgcagacgcacgatgtcggcccttaccagaatgtgccaaccaaacctgttgtgatcctttccgcgaaagtcctgccgtaacattttgcacgggttttgcggcccgtgctcctcttcgctcccctgcgcaacgccggattgccgcttatacttgtggctcatgggcgacaacaacagggaggcgtcatggctaaaaaactcaccgaccggcaaaaatcccgtctctgggaacagcagcgtaacgtcaatttccaggccagcagacggcttgaaggcgtcgagtgtgaagagatcaaactgagcgccgacgaagcgaacgtgcgcattgaagcgttaagggggaaccatgagcgataagtttggcgacgggcgcgatccctatctttaccccggcctcaatgtgatgcgcaataagctcggcattcgtcagacacagcgtctggaagaagcggcgtatcagtttaccgcgctgcgcgccgccaccctgccgttaggcacggatacccccggcctgccgcacctgtgcgccattcaccgccatctgtatcaggatatttttgactgggcgggcgatattcgcgaagtggacatctatcagggcgacacgcgtttctgccatttcgattacatcgaaaaagagggcaacgccctgatgcaggagctggaagtggaaaactggttgcagggtcttgagaaagacgctttcaccgaacgccttgcgcactattattgcgaaatcaacgtgctgcacccgttccgcatcggcaacggtattgcccagcgtattttcttcgagcagttggcgatccacgccggttacatgctggactggcgcggcatcaagccggatgcctggagccaggcgaatcagagcggcgcaatgggcgatctctctgcactgaccaaaatctttagcaaggtggtcagtgaagcgaaagaggcagagtaagccaacgcccggcggatcggtattttttgcaggcccggcaagcctgcgccgccgggcaataaaacaggtacactacccccatcgcattttttgactgaaagatcccgcaccatgatcctgcttatcgacaactacgactcttttacctggaacctctaccagtacttttgcgagctgggcgcgcaggtggaagtcaggcgcaatgacgttattagccttgccgatatcgacagcctgtcaccggacaaaatcgtgatctcccccggtccctgtacgccggacgaatctggcgtgtcgctggaggtgatccgccattacgccggcaagctgccggtgctgggcgtgtgtctgggacatcaggcgattgcgcaggtgtttggcgcgcgcattgtgcgggcgcaaaaagtgatgcacggcaaaacctcgccggtcacccatacggggaagggcgtgtttcaggggctgaataatccgttaaccgttacccgctatcattcgctggtgatcgaacccgcctcgctgcccgactgctttgacgtcaccgcctggagcgatacgcaggaaataatgggcatccgccaccgggagtgggatctggaaggcgtgcagtttcatccggaaagcatcctcagcgaacaggggcatgaactgctggctaatttcctgtcgcgatgattttttgttgccttgttgtgattttttatgcatattttgtgcttatattttcataattaatacagcacaaaacggatgggcgtgacatggcaactgaacaaaacgcaattacgcgcgcaacatttgacgaagtaattctgccgatttatgcacctgctgaattcattccggtaaaagggaagggcagccgcgtgtgggatcagcagggtaaagagtacgttgattttgcgggcggtattgccgttacggcgctcggtcattgccatccggcgctggttgaggcgttaaaaacccagggggaaaccctgtggcacaccagcaacgtctttaccaacgaaccggccctgcgcctgggccgtaaaatgattgaggccacctttgccgagcgcgtgctctttatgaactccggcaccgaagctaatgaaacggccttcaaactggcgcgctactacgcctccacccgtcacagcccctataaaacgaaaatcatcgccttccacaatgctttccatggacggtcgctgtttaccgtgtcggtgggcggacagccgaaatattccgatggcttcgggccgaaaccggcggacatcatccatgtgccctttaacgatctgcacgcggtcaaagcggtgatggacgatcacacctgcgcggtcgtcgtggagccgatccagggcgagggcggcgttacggcggcgactccggaatttctgcaagggctgcgcgagctgtgcgatgaacatcaggcgctgctggtatttgatgaagtgcagtgcggcatgggccgcagcggtgaactctttgcctatatgcactacggcgtgacgccggatattctcaccagcgccaaagcgctgggcggcggcttcccggtcagcgccatgctgaccacccaggagatcgccagcgcgtttcatgttggctcccatggatccacctacggcggcaacccgctggcctgcgcggtagcgggcgcggccttcgatattatcaatacgccggaagtgttgcagggggtgaacgaaaaacgccagcgctttgttaaacatcttcaacagatcgatgagcagtatgacctgttcagcgatattcgcggtatgggtctgctgattggcgcagaactgaagccgcaataccgtggtcgcgcccgtgatttcctgtatgcggccgccagcgaaggggtgatggtgctgaacgccgggccggacgtgatgcgttttgcgccgtcgctggtggtggaagagagcgacatcgacgagggcatggcacgttttgcgcaggccgtcgcgaaaatcgtccacggttaaccctgttgcccggcggcgctgtgcttgcagacttaggctcgtaggccgggtaagcgaaagcgccacccggcaaatttctaatgcttccgctttcctgtccgcatcagccagatgccgtgatgcgggcgctgacgccatgccaccgacgaaatggtgtgcatggtgttcagatgcccgataacacgttgcagatgctgttccagcgtgctcatcgggccctgggttaaggtctccggcgcttccagaatattggcatcccccgaccctgccggcccgtcatattccaggcgctgctggcaacgctgaagcgcaatttcacaggattccagataacgttgcgccagatccggcgtcagcatggtgtgctcgcgcgccagggtggtcatcgcgttaatgtgctcgacgataaactggctgtgcgtcacccagagtttcatatcttccaggtaatgagtgttaaagcccggctcctgcattgcctgattgagcgagttaaacagcgtattgtgtgcctgattgacgcgcatgcgctggtacgccagcggcgtgggctgcggatcgtcgctgaggatcaggcggatggcctcctggtccgcctccagcgcgtcgtgggcgttctgccgcaacagcccgctctgccactgcggccacagccagaccatgccgccaaaggcgatcagacagccaatcagcgtatcgataagcctggcgacgataaactggtcgccgctcagcgtcagcagctgtaacgaatacaccgcggtgatggtgaagcccaccgtcgcccagccataattcttgcggatgatcagatagctaatcagcgtcaccaccagcataccgagcagcgtatagccttccggcacgtgaaagtgcagcgtgataccggcaataatcagccccgccatagtccccgccgcccggtgctgaatacgcacccgcgttgcgccgtagccgttttgcgtcaccagcagtaccgtcatcaggatccagtagggcttgggcagatgcagcgcgatccccatcaggctggcgatggcgagcatcacggcaatgcgcgccgcattgcgcagcgccggggatttaaacgacagatagcttttgagcgccgggatcagcggctggcggcgctgtttatcctccatcagatcgcgcacatacagcgggcgctgggtgcgcagtactctggcgatacggctgaagtgccaggcgcagaactggccgaccgggttatccggatgctgacgggcgattttttccagcgcgccgacctgcttatccatattaaagcgcacaggaaaacggtgatagagaatgtcgtccgccagcacccgcagccgggcggcgaccacctgcgcgttccagcggatcaccgcttcggcgtgactctgctccaccagtttttgcacttcctggggctgatgcaggctgacggaaatatgctcctgcaggtccagcgccacctgaaacgcccgcagcaggcgcttgtaatcgttatgctgattagcggcgagcatgtgcatttgctggtaacactggctgatcagatccacggctttctgctgacgcgccagcagcggcggcagggctttttccggatccgcatgctgggtcagcagactgtatttagcttcgcagtactccgccagctggcggtagagcaggcttaaggattcgcgcagcggctgttcgcgccacatccagaaccacagccagttaaacagcccgtaccacagcgtgccggaggcataaatcagcagcggctcccataccggcatatttccggcaaggcttaaggtaaagatggcggcgataagcgacgccggcagcaggcgcgcgtgcagggcgctgatctctgccgtgacgccaagcagcagcgccagcccgccgaggatcagcggcagggcgatgttctccgccagcaatagctgcaccgccaggctacagcccgcaaacagcgagccgcccacgatcaggcgtttgaaaaagcgtttatggggggtatcgagcccggcaatgttgcagcaggcaggaacgagagagaacagcagcccctgttgcaggtgcccgaaggcgaggccgatggccacagggagacacaacaccagcgtttgtcgcagggcgtagttaatttccgggtgatagatcagcctgcgccacatgagaatgcaaacaaaaacggcgtctcgcagatgcaatacgccgtttgaggggcttagcgggttccgtaaaccacgatggttttaccgtgcgcagagatcaggttttgatcttccagcatcttcagaatgcgaccgacggtttcacgggagcagccaacgatctgaccgatctcctgacgggtaattttaatttgcataccgtccgggtgggtcatggcgtccggctgtttggccaggttcagcagcgtctgcgcgatgcggccagtcacgtcgaggaaggcgaggttacccactttctcggacgtcacctgcaggcggcgcgccatctgggaagacaggcgcatcagaatatccgggttcacctggataagctgacggaattttttgtacgagatttctgccacttcacaagcggttttagcacgtacccaggcactgcgctcctgaccttcttcaaacaggcccagttcaccgataaaatctccctggttgaggtaagagaggatcatctctttaccttcttcatccttgatgagcactgccactgagcctttaacgatgtaatacaacgtttccgctttttcaccctggtgaatcagcgtgctcttcgacgggtacttatgaatatggcaatgagacaagaaccattcgagagtcgggtctgtttgcggtttgccaagcaccatgcgcggttatcctctgttataagctggctccagagccaggatgaacactctgcctctggggttgcaatcatatgcttccctgttcccgggaagtggccgttcgaaaatccagcctttaatgtttgatgtcgtctgcatacatgtgcaacgtcaatgtatcactgtagcagccagaatgttttagcatagcttttgctgtgtgtctcctggtgtctcgcttcagcatgatgcaggtcgccttccgttgcgagaattgttatgtgcgcgtaatctgaagggaaatttaccgcgccggagcgaataaaatgcaagcaagagtcaaatgggtagaaggtttaacgttcctgggcgagtctgcttcaggccaccagatcctgatggacggcaactcaggcgataaagcgccaagcccgatggagatggtgttgatggccgccgggggatgcagcgccattgacgtggtatccattctgcaaaaagggcgtcacgatgtgacggattgcgaagtcaaactgacctccgagcgccgtgaagaggcgccgcgtctgttcacgcacatcaatctgcactttatcgtcaccggcaaagcgctgaaagaagcggcggtagcccgcgcggtggatctgtcggcagagaagtattgttcggtggcgctgatgctggaaaaagccgccactatcacccattcgtttgaggtgattgaggggtgatttttggtgcacgtcaggtggcgctgcgctaaccctgccggatggcgctacgcttatccggcctacaaaagcttaatctgtaggccggataaggcgttcacgccgccatccggcacaaaaaatcactcgattttcttgccttccatcagccgctgcaccagcggcagcatgatcagctccatcgccagccccatttttccgcccggcaccactaatgtattgatgtgggaaatgaatgagccctgcaacatcgccagcagccagggaaaatcgatgccttccagattacggaaatggatcaccacaaagctttcgtccagcgacgggatcgctttcgcggcgaaggggttggaagtatccacggtcggcacgcgctggaagttaatgtgcgtgcgggaaaactgcggcgtaataaagttgatgtagtcttccatcgaccgcaccaccgaatccatcaccgtttcccgtgaatgcccgcgctcgctggtatcgcgcaccagcttctggatccactccaggttaatgatcggcaccacgccgaccagcagatccacatggcgcgacacgtcctgctgtggcgtcaccacgccgccgtgcagcccttcataaaacagcacgtcggtaggttcaggcaacggttgccacggtgtgaaggtgcccggcacctgattccacggcactgcctcatcgtaggtatggagatatttacgtgactggccggtgccggtcagcccgtactcgataaacgtctgctccagcagcccgaagtcatttgcttccgggccgaaatagctgatatgccgtccggcatcgcgcgctttacggatcgccatgtccatttccgggcgcgtgtaacggtgaaagctgtcgccttccacttctgcggcgcgcagatccagttgcgcgaaaatcttacgaaacgcgaggctggtggtggtggttccggctccgctggaacccgttacggcaatcaccggatgtttggcagacatagcaacgctccctaaaactggttttattcgcgaaactgcttcttcggcatgatgttcaccgtttcatgcagttcagaccacaccagcaccgcttctccggtttgcagctggcgcttaacgtcggcgaccttttgttcaagtgaacgctcatgttcaccataatcggtgccttcacgcaagacaaagctctcgatcaggctgtcgagcgtctctgttgccagatcctgccaggggataatcatttacgcctccagatatgttgtcagccagtcgggaatgcgcttttccagccacatttccgggcggcgcagcgtcccgcccacaaagcccacgtgcccgccgtgttccgtcaactgatactccacgttgggcggtaaataacccgccgccggaataacattatgatccataaacggatcgtctttggcatgaatgataagcgtcggcttgcgaatcttcggcaacaccggcatggcgctgcactgacgataatagtcgatggcgtcggtaaagccgtggatacgggcggtgatcagatcgtcaaaatcccggatgcggcgcatacgacgcaggcgggtaagatcaaccggcagtgaatccggatacgccttcagcttgcgcatcgcgttgccctttaacaggttcagcaaatagtgctgataaaagcgcgaaaagcctttatccatatgatagctacaggcttccagcaccagcggagccgatacgatcaccgcagcattgagcggcagatcgggttcatttttgcccagcagacagccgagcatattaccgccgagggaaaaacccaccgctgccgtgggcgctgcgccaaactcacgctgtaaccagtgtaaaaaccaggtgccgtcttccgtttccccggagtggtaaatgcgcttcagacgattgggttcgccactacagccgcgaaagtgcatcaccacgccgagccagccgcgcgcgcgggcggcgttgatcaaaccgtgggcgtacgggctgtgcaggctgccttccagaccgtgaaacaccaccagcctgggcttatgtttggccacatgcggatcttcgctccaggcgagatcgacaaaatcgccatccggcagctcaaggcgctgccactggggcgtgaactggagccgacggcgaatgaggcgcggcagcatggtttgcaggtggggattggctgcgccggccagtgggcgaaatgcaaggctgtcagcggcagtatccgggatctctaagggcgttatttgagccataatcgtgcgatgtgttcttaaaagtctgccgactactatacctgttaaaccccgctgctgcggatgaaattgcgtttccggccctgatgcgttgcctgccatagatactttttgcgttgcttttcctgatctccatcacagattgtcactttgattattactctcaggctaatgattaagcacagggcttaattgatgactttctcaccagagcgcacacttagtgcagtgttaagcaaatcaaaatgatgtgctgaatcaggaggttaataatgttatctgggcaaacgcctgcacgggtatggaacacacgacgtaccgagaaacagcgtcgtctggcttctgtcccggtagaaggcaaagtgctgccgaccgacgacctggtcgccatgctggaaaaacttatcgcacccggcgacaaagtggtgctggaaggcaataaccaaaaacaggcggattttctttcccgctcccttgcgcaagtcagcccgcaaaaagtgcacgatctgcacatgatcatgccaagcgttggccgcagcgaacacctcgatatttttgaaaagggcatcgcccgtaagctcgacttctcgttctccggtacgcaaagcctgcgcatttcgcagctgctggaagacggtcaactggaaatcggcgcgatccacacttacatcgaactctattcccgtctttatgtcgatctgtcgccgaacgtcgcgctgatcgccggctacaaagctgaccgcaaaggtaacctttacaccgggccgagcactgaagacactcctgcgctggtcgaagccgcagcgttccgtgacggcatcgtcatcgcccaggttaacgaactggtggatgacgaatgcgatttaccgcgtgtcgacatccccggctcctggatcgactacgtggtggtagcggacaaaccgttctttatcgaaccgctatttacccgcgatccgcgcctcatcaaacaggaacacatcctgatggcgatgatggcgatcaaaggcatttacgccgaacaccaggtgcagtcgctgaaccacggtatcggctttaataccgctgccatcgaactgctgctgcccacctacggcgaacagctggggctgaaaggcaaaatctgtaaacactggacgctgaacccgcacccgacgctgatcccggcgatcgaaagcggttgggtggagagtgtgcactgcttcggtggtgaactggggatggaagagtatatccgcgcccgtccggacattttctttaccggcgccgacggctccatgcgctccaaccgcgcgttctgccagctggcagggcagtacgcggtggatatgtttatcggttcgaccttacaggttgatggtttcgccaactcctcgaccgtaacccgcggtcgtctgtccggcttcggcggcgcgccaaacatggggcacgatccgcacggtcggcgtcatgccaccccggcgtggctcaacatgatcactgaacccgacccaatgcagcgcggtaaaaaactggtggtgcagatggtggaaaccttccaggcagggtcaaaaccgaccttcgtggaaaaactcgatgccatcgacgtggcgaaagcttccggcatgccactcgccccggtcatgatttatggcgatgacgtgacgcacgtactgacggaagaaggtatcgcttacctctaccgtgccgaaagcatggaagagcgtcgcgcgatggtcgccgccgttgccgggatcaccgatatcggtcttggcgtggacgcgaaacgcgtcgccgacctgcgccgcagcggcaaagtggtttatccggaagatattggcattcgccgcaccgacgccacccgttcgttgctggccgccggtagcgtggcggatctggtggaatggtctgacggtctttataacccgcctgcaaaattccggagctggtaatgaaacatctgccacagattgaagcttgcggaggtgccgaatggctggcgcgaaccgccacccagtgtctgattgacgaagcacggttaagcccgaagcccggtctggtggacagtcgggggaatggggcgcaccacgacctgacgctggcgctgatggagcgttccgcgcgtagcctgacccctacgtttcatgccctggcgcaacaaagctggcaacgtccggcagacattgcgctacgacaaactatcgggcgactgggtcgcgaaggcgaacagcagatgatggctgccaccggcggcgtgaatacgcaccgtggcgcgatctgggcgctgggcctgctggtcagcgcggcagcgatgctgggcggcgcgggcactgcggaggacattgcaaatgtcgccgcacagctggcgcaactgccggacgccgccgccccgaaagtcttcagcaagggcctgcgcgccacccatcgttatcgggtacccggcgcacgtgaagaagcgcagcagggttttccgcacatcgtccaactggcattgccgcagttgcaagccagccgtaaacgcggcggcactgaaacccaggcgcggcttgatgcgctgatggcgatcatgacctcgctcagcgatacctgcgtgctgaaccgcgccgggatgaccgggctggaaaccatgcgtgacggcgcaaaagccgtgctgtcagccggcggaacggcgcagcctgcgggccagcgcgcgctggcgcgacttgacgcgcagatgctggcgcttaacgcctcgccgggcggtgcggctgatttactcgccgccacgctgctgctcgaccgtatcgcgaccttgccttatttatctgattaagaggatgttatggaacacattacgatctctttgcctgccagccgcaccttgagcggtaaagcgctggcaggcgtcgttggctccggggatatggaggtgcttttcaccgccgaccaggagcagacgctcaccgttgatatcaccacttccgtggacaacagccgcggacgctgggaagcgctgtttaaccgtctcaccctggcgggcagcctgccgtccggcaagctggtgatccacgattttggtgcgacgcctggcgtggcgcgcattcgtatcgaacaggtttttgagggggtgagccatgcgtgatgaccgcagttttatcgaattaaaagcgcgtgaacgcgcccgcacgctgctggacgacggcagctaccgtgaattgctggatccctttgaaggcattatttccccgtggcttgggccgcagggcatcgtgccgcaggccgatgacggcatggtggtggcgaaaggcaccattaatggccagcctgcggtggtgatcgccatcgaaggcaccttccagggcggcagcatgggggaagtgtccggcgcgaaaatggcagcggcgctggagctggcggcggaagataaccgcaacggcatcccgacccaggcggtactgtgcctcgaaaccggcggcgtgcgtttacaggaagccaatctggggctggcggcgattgccgatattcatgccgccattgtcgatctgcgccgttatacgccggttatcggcattgtggccggtaccgtgggctgctttggcgggatgtccattgctgccgcgctgtgcagctatttaatcgtcacccgcgaggcgcgcctcggtcttaacggtccgcaggtcattgagcaggaagcggggattgaagagtatgactcccgcgaccgtccgtttatctggagcatgaccggcggggaagtccgctatcagagcgggctggtggatgcgctggttggcgacggggtgaatgcggtgaaaggcgcgatgaacgactttatcgccaaaggcgtaccggaaaaacaccgcaccgataactaccagtggtatctggatcgtctcacccagttcgacacccgcaaacaggcggatgccgaacagatcaaagcgctctttgccggggaggaaaaagcatgaatacgacagtaagccgtggcgcattatggcttgaaaaactggcgcccaacgcaccacgtttgagcgggttatgcccgtcggtccaggtggctgacggtgaaattaacggtgaagcggcacgctttatcgccgtggtcccggatacgcataaccactatccccgcgcggcaaacggtgaagtcggtctgctggaaggctggacgctggcgaaagtggttagcgaaaccatcgccgccgacgccggtaaaagcgttaaacgcccgatcgtggcggtgattgacgtaccgagtcaggcctatggccgccgggaagaaggttttggcattcatcaggcgctggccggtgcggcaggggcttatgccaatgcccgtctggcaggtcacccggtgattggccttatcgttggtaaagccatgtccggtgcgtttctggcgcacggctaccaggcgaaccgtctgattgccttcaacgacaacggcgtgctgatccacgcgatgggtaaagagtctgccgcgcgtatcacgctgcgtaccgttgacgcgctggaaaaactggcggcgaccattccgccaatggcgtatgacatcagtaattacgccacgctggggctgctggatcatctgctgaacatcagcaatccggaagcgccttccgatgccgatctggcggaggtgaataccaccctgcaacaggccattcacgacgcacgtcaggacaccacgcttaaaaaccgtcttggtgccgacaaccgtcgcagctcgtcactcgtgcgggagcgcatgcgcgcaagctggtaagaagtaaaaaagacctgccggaatgaccgccccgtgggcacatacgctgtgcccatgaggaagcgtgcatctgaaaaataacaaacatcgcgtcagtgctatttccttgtttatctataggtgatttatgacttacgtaattgttcatgctctcgcaccgatttttgtgattatgctactgggattctgggccggtaaggccggaatggtggataacaaaaatgtttccctgcttaatattttcgtgatggattttgccctgcccgccgcgctgttcagcgccacggtgcagacgccgtgggacggtattgtcgcccagtcgccgctgatcgtggtgctgacgctggcgatgtggatcacctacgccatcatctatttcctcgccaccagcgtctttaaaaaatcgccgcaggatgctgctgtgctgaccctgaccgttgccctgccgaactatgcggcgctgggcctgccgatcctgggcagcgtgctgggtgaaacctcgtctacctcactctccgtggcggtatccattgcctgcggttccgtgctgatgacgccgttctgcctgctgatccttgaacgtgaaaaagcgcgtgcggaaggcggtaacagcggttcaaccctggcgatgctgccggtgctgatgtggcggtcgattaaaaaacctatcgtcatgggcccgctgttaggggtgattttatccgccatcggtattcatatgccggatctggtgctggcggccattaaaccgctgggcctgtccgccactgcggcggcgctgttcctgaccggcgtgatcctctcggcgcgtaaactgcaaatcaacaccatggttattacctcgaccatcgctaaactgctgatccagccagccattgcctgggggatcgtgctggcgttaggcctgtccggcccggttgccattaccgctatcctgatgatcgcgctttcggccggtttcttcggcgtggtcttcggtaaccgctttggcgtacagtcgccggatgccgaagccgtgctgttgttaagctctgtgctgtgtattctgtctctgccgctgtttatctcgctgacatcaggaatgtaaaacatgacttcatcatcattgcgaccgcacgatcttctctggctggctgaccgcagcgccctgcagggggtgacggaatcctgggtggatacggtctggcatgcggggttgccggtagtggtgcggcgtgatgttgatgagcaggggcgcatcccggtgggggtgcgcggtctgcgccgcgaccagcgtgcgccaggctgggtggatgcgcagcaggttgtgcgcgttgtcacccccgaacagctgaccgacgcccgggcgctggtcagctcgccctttatctccgcgccacccgttcaggtggcgtttcagctggcgcagcatgggtggccgtgggtctgggggatcaccggcagcgtcggctatgcgctggcgaccggcatcccggtgatccatgccgcaagcgatctggatctgctgatccgcgccccgcagccgctgtcgcacgatgcgctgatacagtggcagcaacggctggacaccgccctgtgccgcgccgatacgcaggtggagacgccatccggcggattcgcgctcaatgagtggctgcgtgacggtcaggcactgctcaaaacccgtcagggaccgcgtctggttagcgatctctggcgcagggaggactaatgaaaattctgtttacctttcccggccagggaacgcagcatcccggcatgttgcaacagctgcccggtacggcgcttgcagaagcgcgtgaagtgctgggcgcggaagtcgataccctggatatgcctgaagcgctggagcatacccgcgcggtgcagctgtcgctgttgatcgccggtgtcgcctgggcgcgggaactgcaacggcagggcgtggagccagatatcgtcagcggcctgtcgatcggcgcgtacccggcggcggtggtggccggtgcgctggcttttgacgatgcgctgcggctggtggccctgcgcggcgatttgatggagcaggcgtacccgcacggttacggactgacagccatcatgggtctgacgctgccgcaggtcgaagcaataagcgaaggcagccagacctggatcgccaacctgaatgcggaaacgcagattgtgatcgccggtcgtgatgaagagatggcgcaggtggcggaaaaagcgctggcgaaaggggccagcaaggcgaagcgtctggctgtcagcgtgccgtcgcactgtgaactgctgacccgtccggcggaaaaactggcacaggcctttgccggggtgagtttgtcccgtccggcgtgcgcttacctgagcggcagtaccggacgcgtgctgtggcagccggagaaaatcgccgacgatctggcgatgaacatggcgcgtaccgtacgctggcaggaggcggtgatttccgccaatgagcgtgaagcgcggctggccatcgagatgccaccgggcggtattctcacctgtttaacgcggcaggcggcctgggaaggggagtccatttcgctggagcgcagcggcgttgatgtggcgctgcacctggcgaaacgtctgcgggagcagcgataacgcattgcccggcggcgcaggcttgccgggcctacaacgacatagcttgcagatcgcgtaggccgggtcaggcgcagccgccacccggcaaaagggtccgtcataaaattatgcaggtcagataagcgaagcgccacccgacaggttcaactcagccacccggttcctgcaaactgcgggcgtacatgcggccttcggcggcgagcgccagcagattcggatcgtgctcgcggttgcgaggaaagacgatggcgatcaactgctgcatctggtacggctcggcgagctttaacagctgcaccgagttttcatacactttcttcatgcggcccggcatcagggtaaaaccaacgcctgcctgcaccagactcagcatcgagaaaatgtcgtttacgcgcgtaacgatctccggctcaaaaccggcaatgtgaaaggcttcctgaaagcctgcgtaggtggcgaaaccttccgccagcgagacaaatttttgctggcggtaatcgcgtaaatcggcaggtgctgacatgttgagcgtggccgacgcgggcgcggcgaggaaaatatcatcgtgaaacagcggcaacacttcgaggctgttgcgatcgatttgcgcctctgacagcgaaatgataatcgcgtccagctccccggcgtccagcatgtgcagcagggtttcgttagaacccatggtcagcgccatctccagctccggccggcgcagcttcatgcccatgatcagacgcggcacggtttccagcgtcagcgagtagagcgtgccgacacgcagccgcccctggccgacgcctgcttctttgcgcgcctcttccagaccacgcgtcatcagttgcgtgacttcctgacaatactccagcagcgtccaggccgcgggcagcggcatcagggtgcgacctttatgcacgaacagtgggcagcgcacgttttcttccagcgtatgcagcgcgcgatgtacgctcacgccgcttaacgccagcgcttctgcggtgcgggcaatgttccccttttccataaaggtcatgaaaatggcgagcttgcgaaacgtgatctcactgaggatgtcgtggctcatggtcagtcgctttgcagcatagcctccagctgttcctgggcgtccagccatgccatttcacactcttcaagcccggctttcgcgctggcctgcgcctgtaaacaggcggtgagttcggctttgcggctctggtcgtacagcccgctgtcgctcagtttttcttccgccgcggcctgctgtgcctggaacttctccatctctttttccagacgggcgatctctttgcgcagcggctgcgtctgggtgcgcagttccgcttcgcggcgcttctgatctttacgcgactgggcgctgttggcgttctctttcgcgccttcggcaggctggttttccagtttctggatgtcgctcagccactgctgatagtcttccagatcgccgtcgaaggcctcgactttaccgccgtgcaccagataaaactcatcggtggtggagcgtaacaggtgacgatcgtgcgacaccaccaccagcgcgccttcgaattcgatcagcgcttcggtgagcgcctggcgcatatccagatccaggtggttggtcggttcatcgagcagcagcaggttagggcgctgccagacgatgagcgccagcaccagacgggctttttcgccgccggagaagcggccggtcacttcactgactttatcgccctggaaaccgaagccgccgaggtaatcgcgcagcttctgctccagctcctgcggcgcaatgcgcgccaggtgctggattggggattcatccgcgcgtaaaaattccagctgatgctgggcgaagtaacccagcttgatacctttcgccagaccaatctcaccgcttaccgggtttagctcgcccgccagtaatttgatcagcgtcgatttacccgcgccgttacgccccagcagaccgatgcgcgaaccgggaaccaggttgagcttgatggaatcaagaatggtgcgatcgccataaccggcgctgaccttttccattttcagcaacggattcggcaggctttcaggggcgcggaagctgaagtggaacgggttatccacgtgcgccggggcgataagctccatgcgctccagcattttcacgcggctttgcgcctgtttggctttgctggctttggctttgaaacgatcgataaagctttgcagatgcgccacccgcgcctgctggctttcgtaagtggcctgttgctgggcaaggcgcgtcgcgcgctggcgctcgaaggcgctgtagttgccggtgtattcgaacatgttttgctgttcgatatggataattttgtccaccaccggatcgaggaaatcacggtcgtgagaaatcaaaatcagcgtgccctgatagcttttcagccatttctccagccagatcaccgcgtcgagatcaaggtggttggtgggttcatcgagcagcagtaaatcggaacggcaaatcagcgcctgcgccaggtttagacgcatacgccagccgccggagaagtcgctcaccgggcgctcaagctgttcatttgaaaaaccgaggccgtgcagcaggctggacgcgcgggagcggatggtccaggcgtcgatggcgtcgagcttgccgtgcaccgtggcaatcgcgtgcccatcgttacgttcgttagcggcgttgagctcagcttcaaactgccggtactggcggtcgccgtcaatcacgtaatccagcgcgggttcgctcagcgccggggtttcctgattaacccacgccagctgccagtttgccggataggtgaagctgccgccgtcggcgctgagttcattttttaacagcgccagcagcgtggatttcccgcagccgttttttcccaccagtccgaccttctggccgggattgatggtggcagtggcattgtccagcaggacgcgtacgccgcgacgaatttgtaacgaggagaaaacaatcatagagcgccgttatgttccgactatattaatttgtcattatgatattttagggtagtgggcaatgtgccgcaccggggcgccatggtagcccaaaacgaagcctggacacaaaatcattagaatgacgtgcacgacgcccgggaggggaatgatgccaccaacagcgaaagtattgctgttatatgcccatccggaatccggagattcggtcgccaaccggctcttacttaaaccggcaacgcaactcagtaatgtcaccgtgcatgatctctatgcgcattaccctgatttctttattgatattccccatgagcaggcgctgctgcgcgagcatgatgtgatcgtgtttcagcatcccctctatacctatagctgtccggcgctgctgaaagagtggctggatcgcgtactgagccgcggctttgccagcgggccggggggaaatcaactggcgggaaagtactggcgtagcgtcattacgaccggtgagccggagagtgcttaccgctatgacgcccttaaccgctatccgatgagcgatattctgcgccccttcgaactgacggcggccatgtgcaaaatgcactggcttacgccgatgattatctatcatgcgcgtcggcaaccgccggaggagctggcgagccatgccagagcttacggtgactggctggcggcgcctgtcgccacaggaggcctgtgatggaaggttccgatctgttactggcaggcgtgctgttcctgtttgccgccgtggcggcggtaccgctggcggcgagactgggcatcggcgcggtgctgggttatctgctggcggggattgccatcgggccgtggggcctcgggtttatcagcgatgtggatgaaattctgcatttctccgagcttggcgtggtgttcctgatgtttatcatcggcctggagctgaacccgtccaaactgtggcaactgcggcaatcgattttcggtatcggggcggcgcaggtgttgctgagcgcggcgatcctcgccgggctgctgatgttgacggagttttcgtggcaggcggcggtgatcggcggcctggggctggcgatgtcctcaacggccatggcgttgcagttgatgcgcgataaaggcatgaaccgcaacgaaggcggccagctcggattctcggtgttgctgttccaggatctggctgtgatcccggcgctggcgctggcgccgctgctggcgggtaacgccgatgaacatctggactggatgaaaatcggcatgaaagtgctggccttcggcgggatgctggtgggcggtcgttatctgctgcgtccggtgtttcgttatattgccggttccggcgtgcgggaggtgtttaccgccgccacgctgttgctggtgctgggttcggcgctatttatggacgctctcgggctgtcgatggcgctgggcacttttatcgccggggtgctgctggcggaaagcgagtaccgtcatgagctggaaatggctatcgatccctttaaggggctgctgctggggctgttttttatctccgtcggcatgtcgctcaatttaggcattctttatacccatctgctgtgggtgctggtcagcgtcattgtgctggtggtggtgaaagggctggtgctgtacggcctggcgcgcctgtacggactgcggcgttccgagcggatgcagtttgccggggtgctcagccagggcggggagtttgcttttgtgctcttttcggcggcgtcatcccaaagattgttccacaatgatcagatggccctgctactggtgacggtgacgctgtcgatgatgaccacgccgctggtgatgaaaatcgtcgataaacagctgtcacggcactttaacggcccggaagatgaggacgaagcgccgtgggtagaggatgataagccgcaggtgattgttgtcggctttgggcgtttcggtcaggtgatcgggcgtctgctgatggcgaacaaaatgcgcatcacggtgctggagcgggatatcagcgcagtcaacctgatgcgaaaatacggctacaaagtctattacggcgatgccactcaggtggagctgctgcgctcggcgggcgcggaggcggcgaagtctatcgtcatcacctgtaatgagccggaagacaccatgaagctggtggaaatctgccagcagcacttcccgcatctggcgatcctcgcccgtgcgcgtggccgtgtggaagcgcatgaactgttacaggcgggcgtgacgcagttctcccgcgaaaccttctccagtgcgctggagctgggacgcaaggcgctgattacgctgggcgtgcatccccatcaggcccagcgcgcgcagctgcacttccgccgtctggatatgcgcatgttgcgcgaactgatgccggtgcatactgatacggcccaaatctcccgcgtccgggaagcgcgccgcgagctggaagagattttccagcgcgagatgcagcaggagcggcggcagtttgacggctgggatgaattcgagtgaggcaaaattatgacaatacgtaaacgctttatcgccggtgcgaaatgcccggcctgccaggcgcaggatacgctggccatgtggcgggaaaataatgttgatgtcgttgagtgtgttaagtgcggtcatcagatgcgcgaagcggataaagaagcccgcgagcatgttcgcaaagaagagcaagtgatcggcatttttcatccggactagcgatataccccagctttttttatgcttaagggtacacaggggcagaattccgttacaatctgcgccagcaattttcccacgctcaggagatatcatgaaagtagcaaaagacctggtggtcagcctggcctatcaggtacgtacagaagacggtgtattggttgatgagtctccggtgagtgcgccgctggactacctgcacggtcacggttccctgatctctggtctggaaaccgcgctggaaggtcacgaacctggcgacaaatttgatgtagctgttaccgcaaacgaagcttacggtcagtacgacgacaatctggtacagcgcgtaccgaaagatgtcttcatgggcgttgacgagctgcaggttggcatgcgtttcctggctgaaactgaccagggtccggtaccggttgaaatcactgaagtggaagacgatcacgttgtggttgacggtaaccatatgctggccggtcagaacctgaagttcaacgttgaagtggttgccattcgtgaagcaacggcagaagaactggctcacggccacgttcacggtgcccacgatcatcatcacgaccatgaacacggtgacggttgctgcggcggccatggccacgatcacggtcatgaccacgaccacggtaaaggtggttgcggcggtcacggcggctgcggttgccactaatgcgttagcgctccggcgctgtacgatcaaaaaagcgggatcttcccgctttttttacgccttaatagtggggcggcggcgtctcttctgactgggacgcgatgtgcgatggctggctggctttgagtttgtctgccatcaaacgcagatgctcgcgcattttcgccatctccagttcatgggcggtgaccgtgaggttgagttcttcaatggttatttcctgaaaagccagacgactttccagttctgccagtcgcgcttccagcgtcatttcctgcatcattcacctcttttgtcgtcgttgttatcgggccaggcggcgggcggattctactgaagtttacgccctcgcgcagcaaccggacgtcctgaagaaactaatttaaacaaaaatagtctcaaaagaagcgattatcggggaagtccatatgttgattttctccgcaacgttttatagtacgcttcttaataagttaacaagggggatccccccggccctggagaaatggatgaaatcactgttaaaagtaacgctgctggcaacgacgatggctgtcgcattgaatgctccgctgaccttcgctgcggataccgctgcgaaagccgcacctgcggcagacagcaagtctgcattcaaaaatgatgaccagaaatcggcttatgcgcttggcgcatcgctgggtcgttacatggaaaactccctgaaagaacaggaaaaactgggtatcaagctggataaagatcagctgatcgcgggtgttcaggacgcctttgctgataagagcaaattgtccgatcaggaaattgaacagaccttacaggctttcgaaacgcgtgtgaaatcttctgctcaggcgaagatggacaaagacgcagcagataacgaaaacaaaggtaaagcttaccgcgacacctttgctaaagagaaaggcgtgaaaacctcctctaccggcctgctttacaaagtagagaaagaaggcaccggcgatgcgccgaaagacagcgacaccgtagtcgtgaactacaaaggtacgctgatcgacggtaaagagttcgacaactcctacacccgtggcgagccgctgtcattccgtctggacggcgtgatcccaggctggactgaaggcctgaaaaacatcaagaaaggcggcaaaatcaagctggttatcccaccggcgctggcttacggtaaaaacggcgttccgggtatcccggctaactccaccttggtctttgatgttgagctgttagacatcaaaccagcaccgaaagcggaagcgcaggcggaagccgcaccggctgaaaaagcagctgacgcggataagaagtaagcacgctgaaagccgccgcctgaatgggcggcggttttttattgcagggccgatatatactctacctgacgcgtctgtgtcctacagcgccgcggagttaattaacgctggcaagcattgcccgcgctgtattaacttagttgtccgtgtaaatgatgagcctgccctgaaaagttaacgacaggctcctgaaaaggagtgttttttttcatgtccaggtcgctattaaccaacgaaaccagtgagcttgatttgctggatcaacgtcccttcgatcagactgacttcgatatcctcaaatcctacgaagcggtagtggacgggttagcgatgctcattggctcccactgtgaaattgtattgcactcgttgcaggatcttaaatgctccgccattcgcattgctaacggtgaacacaccggccgcaaaatcggatcgccgatcaccgatcttgccctgcgtatgctgcatgacatgaccggtgcggatagcagcgtctccaaatgctattttacgcgcgccaaaagcggcgtactgatgaagtctgaaactatcgccatccgcaaccgtaaccagcgggttatcggtttgctgtgtatcaacatgaatctcgatgtgccgttctcacagattatgagcacctttgtgccgccggaaacgccggacgtcagttcgtccgttaacttcgcctcctcggtggaagatctggtcacgcaaacgctggagttcaccatcgaagaagttaacgccgatcgcaacgtctctaataacgcaaaaaatcgtcagatcgttttgaatctttacgaaaaaggcattttcgatatcaaggacgccattaatcaggtggcagaccgtctgaacatctccaagcacacggtttatctctatattcgccagttcaaaagcggcgatttcctggggcaagagaagtaatgcgtttcgccattctcgtcacaggccctgcctatggcacgcagcaggccagcagcgcgtggcagtttgcccgggcggtgctggctgccggtcatgaactggtcagcgtgtttttctatcgtgaaggcgtttataacgccaatcagcttactgccccggccagcgatgaattcgatctggtgcgtgcctggcaacagttgcagacggagcatcaggtggcgctgcatatctgcgtggcggccgcgctgcgtcgtggcgtgacggacgaaaccgaagcccgccgtctgggactgtccggcgcgaatttacagccgggctttgtgctgagcggcctgggctcgctggcagaagccgcgctgacctgcgatcgaatggtgcaattctgatgaaatctgtcgcttttgtgtttaagactgcgccgcacggctcagcggcaggacgggaagggctggatgcgctgctggcgatgtcggcgctgactgaagagatcggcgtcttttttatcggcgatggcgtattccagttgctgaaagaacagcagcccgctgcgatcctggcgcgtgactacatcgccaccttcaaggtgctgccattatatgacatcgaacagtgctggctgtgcgcggcctcgctacgggagcggggcttatccgcctccacgccgctgatcctggacgcacaggcgcttgaaccggatacgctgcgtgcccggctcaatgattttgatgtggttatgacgttctgaggcccttatgctgcataccttgcaccactctccctggcagtgtgatatgaccatgctactgcgtaccatgcaggccggggacgatctcttacttttgtccgacggggtagttgctggcattgaaggcgggcattaccttgatttactgctggccgcccccatatcggttcatgcgctcaacgaagacgtcgtcgcgcgcggcctttctggtcaaatttcgaacaatattgccagggttagctatactgaattcgtcagcctgacggtaaaacatgccgttcagatgtcctggtagtgtggatcgctgtatatttcttgacaccttttcagcacagctctaaaattctgcgtcctcatattgtatgaggtcgatttattacgtgtttacgaagcaaaagctaaaaccaggagctatttaatggcaacagttaaccagctggtacgcaaaccacgcgctcgcaaagttgcaaaaagcaacgtgcctgcgctggaagcatgcccgcaaaaacgtggtgtatgtactcgtgtgtacactactaccccgaaaaaaccgaactccgcactgcgtaaagtttgccgtgttcgtctgacaaacggttttgaagtgacttcctacatcggtggtgaaggtcacaacctgcaggagcactccgtgatcctgatccgtggcggtcgtgtaaaagacctcccgggtgttcgttaccacaccgttcgtggtgcgctcgactgctccggcgttaaagaccgtaagcaatcacgctccaagtatggcgtgaaacgtcctaaggcttaatggttctccgttaagtaaggccaaacgttttatattaatgtcaaactaaactctttgagttttggacaatcctgaattaacaacggagtatttccatgccacgtcgtcgcgtcattggtcagcgtaaaattctgccggatcctaagttcggatcagaactgctggctaaatttgtaaatatcctgatggtagatggtaaaaaatctactgcagaatccatcgtctacactgctcttgagaccctggctcaacgtagcggtaaaggccacctggaagcgttcgaagttgctctcgaaaacgtgcgtccgactgtagaagttaagtcccgtcgcgttggtggttcaacttatcaggttccagttgaagtacgtccggttcgtcgcaatgctctggcaatgcgttggatcgttgaagctgctcgtaaacgcggtgataaatccatggctctccgcctggcgaacgaactttctgatgctgcagagaacaaaggtactgcagttaagaaacgtgaagacgttcaccgtatggcagaagccaacaaggcgttcgcacactaccgttggtaatcccttcggagtattagtcaccaggcgggcgcttcataaaagctgcccgctttgggctacttaaattgaacgccaaaggcaatagaggaatcaaatggctcgtacaacacccattgcacgctaccgtaacatcggtatcagtgcgcacatcgacgccggtaaaaccactactaccgaacgtattctgttctacaccggtgtaaaccataaaatcggtgaagttcatgacggcgcagcaactatggactggatggaacaggagcaggagcgtggtatcaccattacctccgctgcgactaccgcattctggtctggtatggcgaagcagtatgaaccgcatcgcgtaaacatcatcgacaccccgggccacgttgacttcaccatcgaagtagaacgttccatgcgtgttcttgacggtgctgtaatggtttactgcgcagttggtggtgttcagccgcagtctgaaaccgtatggcgtcaggcaaacaaatataaagttccgcgtattgcgttcgttaacaaaatggaccgcatgggcgctaacttcctgaaagttgttggtcagatcaaatcccgtctgggcgcgaacccggttccgctgcagctggcgattggtgctgaagaaggcttcaccggcgttatcgacctggtgaaaatgaaagccatcaactggaacgatgccgaccagggcgtgaccttcgaatacgaagacatccctgcggacatggctgacctggctgaagaatggcaccagaatctgatcgaatctgctgctgaagcttctgaagagctgatggaaaaatacctgggcggcgaagagctgaccgaggaagaaatcaaatctgctctgcgtcagcgcgttctgaacaacgaaatcatcctggtaacctgtggttctgcatttaagaacaaaggtgttcaggcgatgctggatgcggtaattgattacctgccagcaccgacagacgtaccggcaattaacggtatgctggacgacggtaaagacacgccggctgagcgtcacgcaagtgatgacgagccgttcgctgctctggcgttcaaaattgctaccgacccgttcgtgggtaacctgaccttcttccgcgtgtactctggcgtggttaactccggtgataccgtagtgaactccgttaaagctgctcgtgagcgttttggccgtatcgttcagatgcacgctaacaaacgtgaagagatcaaagaagttcgcgcgggcgacattgctgcggcaatcggtctgaaagacgtgactactggtgataccctgtgtgatccggagcatccgatcattctggaacgtatggaattcccggagccggtaatctccatcgccgtagaaccgaaaaccaaagctgaccaggaaaaaatgggtctggctctgggccgtctggctaaagaagacccgtctttccgcgtatggactgacgaagaatctaaccagactatcatcgctggtatgggtgaacttcacctggacatcatcgttgaccgtatgaagcgtgagttcaacgttgaagctaacgtgggtaaacctcaggttgcttaccgcgaagcgattcgcgcgaaagttaccgacattgaaggtaaacacgctaagcagtctggtggtcgtggtcagtacggtcacgttgtgatcgacatgtacccgctggagccgggctcaaatccgaaaggttatgagttcatcaacgacattaaaggtggtgtgattcctggcgaatatatcccggccgttgataaaggtatccaggagcagctgaagtctggtccgctggctggttatccggtagtagatctgggcgtgcgtctgcacttcggttcttaccatgacgttgactcctctgaactggcgtttaaactggctgcgtctatcgcctttaaagatggctttaagaaagcaaaacctgttctgcttgagccaatcatgaaggttgaagtagaaacgccggaagagaacactggtgacgtcatcggtgacttgagccgtcgtcgtggtatgctgcgcggtcaggaatctgacgtgactggcgttaagatccacgctgaagttccgctgtctgaaatgttcggatatgcgactcagctgcgttctctgaccaaaggtcgtgcatcatacacgatggaattcctgaagtatgatgatgccccgaacaacgttgctcaggccgtaattgaagcccgcggcaaataagcccaggttttaaaacattgatcccgtgctccctccttgaggggggagcactatagtaaggaatatagccgtgtctaaagaaaaatttgaacgtacaaaaccgcacgttaacgtgggcaccatcggccacgttgaccacggtaaaactactctgaccgctgcaatcactaccgttctggctaaaacctacggtggttctgctcgtgcattcgaccagatcgataacgcgccggaagaaaaagctcgtggtatcaccatcaacacttcccacgttgaatacgacaccccgactcgccactacgcacacgtagactgcccgggccacgccgactatgttaaaaacatgatcaccggtgctgctcagatggatggcgcaatcctggttgttgctgcga

SEQ ID NO: 5 - DNA, 131835 bp, Enterobacter sp SA187
gaattacgtatgttcactccagagacttggtattcatttagcgtccgaagacgtttaagaatccatgtccttgagtgcccacacagattgtctgataaattgttaaagagcagttgcgacgcgctttggcgctgtgtcgcgaggtcccgtataatacgttttcctcattcagagtcaagcgattattttgcttttctctgccggtcattcccggaagaagaccttctgacccggtggcctgtaagccgttgttccgtgtcagtggtggcgcattatagggagttattccgggctgacaacccctaaattcaaaaaatttatcaaccgtctcttttttgctcaaaaacgtcctgaaccgccagtttttcgagcattttgaagccatagcgctgcaaaacgggcagtaattgtacggcttcaggcgtggcctccatacagaacgcgatattttcatccgccgatttcgcatcaggcgcgtcatgctctaatagccataccgtgcgacgcgcaatggccgcaccggaatccaccagccgggtgccgtcaggtaaaacctgtagcagctcctcgcgcagcagggggaaatgcgtacagcctaacaccacggtatccggcggttccggcatccgcagccacgggcgcagaatgcgcttcaggttttcaagcggaacaggtttaccgtgcagcttggcttccgccagctcaaccagctctgatgaacccagcatttcgatatggcattcattcgcgaaacgctggatgagttcatgcgtataaggacgctttaccgtgccgcgcgttgccagtaagccgacgatgccgttagccgtcagtcgcgccgcaggtttgatggcgggaaccactcccacaaccgggaactggaatttttcgcgcagagcaggaagggaaacggtgctggcggtgttgcaggcaatgatggccattgccaggggatagcgcgcctgaacagcagtgacaatgttcagcacccgctccacgataaaggcttcgcttttttccccgtaagggaaagccacattatcgaaggcataaatgtaatgcagatccggcagcagttgccggatctcatcatagaccgataacccaccgacgccggagtcaaacaccagcacggtaggtttgaggtcagaaggtgtagctgccagacaagttgtattctcgtcctgcagtttggtagccataagctgtctcgtaatctttatcgaacaggttagctattttaccacgaactgtaagatgagaggtgacaggatatgacgctgtgacatccacggtgctgtaactcggcagcctttgctgcacgttattgtactccgaggtattgttgtcataacgcttgccaaaatattgccaggaaacgtccatacctacgtcaaacatcgtccagtcgagctgatacttcgcctgctgccgggaacggcgcgccagcacttcatcgttttcatcattacgcggatcgacatattgcagcgtcacgcgatggttgaaaatgccggtatcgaaactccccgtccattccacgcctttaatggtggcagagttaatattgtcgtacgcgccggcaaaggtcaccggatcggaatagtaggtgatcagattgctgatttcgtagcgataggccgacaggcgccagtccagcggcccggtcagaccttcaagccccgcctcccactgttttgactcttccggcttcagattcgggttggaatcaataccgaaacgggttgagccgaactgctgccccagcgacggcgcaaggaaccctgtaccgtaggaaagggttaagcggtaatcctcaacaaactcccagcctgcggcggtctgccaggtaccgtgccagccaaattgctcatcatgatcttcacgaccagaggcttccagcgtcacgtcgccaaactgctgctgcccggtaagatacagaccggtatcatcgcgcttataggtatctgacgttgcggtatcggaagacgtcaggcgttgctgctgccagtcgacgccgccgctcaccgagccatggccgacgataaggttattaccccattgcagattacgctgctccagacggtccagcgaagagccgtcctgataacggccataaatgctgctgtagttgtaatctttgattttctgatagctggcaatgagctgcgaagagtaaatgccggagtgatattccagaccggtatcccaggtctggttataaagctgattttcatcggcgctgtaagctggcatgaacggcgggctgccaagatcgtaatcgacgttattggcatagctatggccacggaagaagccattgaagttgtcgttaaacttatgctcgacgctgccccagaacgttttgttgtggtagccgtcgcggtcattgtcgtgatcccagctggagccaggctgcacattaaagccacgggtgctttcgtaagaacctgccagcgtcgccagggtatcgccgaaacgctgacgcagcgcgccatcgtactgctgatagcctttcgagcctacgctggcggtaattttcgactgttcttcatcgcttcgggtaatgacgttaatcacgccgcccatcgcgccggaaccataaatcgccgaacgcggaccgcgaatgtattcgatacgctgcaccagggacaccgggatttggttgagatcgggattattggtgatgcctggtcgccccatcgggataccatccaccagcaccagcacctgtcgcccttcggtaccgcgaacgtacagcgtggagttttgtttcatcccgccgttctgcgcaatatccacgcccggtaaacgacgcatcacatcattgagggtttttgcctgccagcggtcaatctcttcacgggtcacaacatccgtaggtgccagtaccgtgccaacgggctgctgaaaacgatttgcggtgacgacaacgttgtccgggttgctatcctgcgcccagccagaaaatgccgtgacggagagcgccgtcagcagcgaagtttttttaatcattgttaaagcatccacaatataagaaggatgccgcaggccccatcgatagcacgcgatgatgtgaaccaaatgcgacgttaaccggcaggtcttcgggctcgaaagtacaacagatgatgacttcccaccttacggcagtgtctgctttcgctatcacccttaacttcttaccgctgcgcgtcagctccagatttgcactggattcccttttaactcaggagaccggaaagcggatgctacatttagttacatatagatgtccagactgctaattaagaaatccgaaaaccgcagggctggacaatacgcacacaatccctacaatccccgcgtaattcaatcttactcaggacgcaccatgaccccagaacacctcccaacagaacagtacgacgcgcaactggccgaaaaagtcgtccgactgcaaagtatgatgacgccttttgccgcgccggttccggaggtgttccgttccccggtcagccattaccgtatgcgtgccgaattccgcatctggcatgacggtgacgacctgtatcacatcatcttcgaccagcagacgaaaaaccgtattcgcgtcgacagcttcccggcggccagcgagctgattaaccagctgatgcgcgccatgatggagggcgtacgccactccccggttttgcgtcataagctgttccagatcgattacctcaccaccctcagcaatcaggccgtggtatcgctgctgtaccataagaagctggatgatgcctggcgcgaacaggccgaagccctgcgcgatgcgctgcgggcgcagaacctgaacgtgcacattattggtcgcgccacgaaaaccaaaatcgcgctggatcaggattatatcgacgagcgactgccggtcgccggcaaagagatgatctatcgtcaggtagagaacagcttcacgcagcctaacgcggccatgaacattcagatgctggaatgggcgctgaacgccacaaaaaattcgacgggggatttgctggagctgtactgcggaaacggcaacttctcgctggcgctggcgcgcaacttcgatcgggtactggcgacggaaatcgccaagccgtcagtggcggcagcacaatacaatattgccgctaaccacattgataatgtgcagattatccgcatggcggcagaagagtttacccaggcgatgaacggcgtgcgggaatttaaccggctgcaggggatcgatctgaaaagctatcagtgcgagacgattttcgttgatcctccgcgtagcgggctggacagcgaaaccgagaagatggtgcaggcgtacccgcgtattctgtacatttcctgtaacccggaaaccttatgcaggaacctggagacgctgagccagacgcacaatattgaacgtctggccctgttcgatcagttcccgtacacgcaccatatggagtgcggcgtactgttgacccgtaagtaagcggcttattccggcagttcatgcctgcggttacgcaggcgataaccgatccagaataccagcgccacggagagcaccgcaggcacgaagttagagccgatagccggatactctgcgcgcaccacggcgctgtaaagcagcacgccaaggatgaaacacgccgccgccagaccgggtaaacccaccggcatggtacggttctgataacgctgatgcagacagtacaccgtcagcaccagcgcaataatcgggaagatggaaaacggcacaacagaactgaaaatggcggtaaaggtgccattgatggacaggccagcgatcagcgccagcagcaatgtacctttatcttgaactgtctgtttcattactcatccttcactcatcgggttgttgcgaaattttctcttgttcacggcgataccagtaatacgcgcctttggaaatcatccgcagctgtaaaaccagtcgctcttctaattgccgacgttgttccacgccaatatctaatgcttcagcgcctgcgttaaagacgatagtgaccatcgcttcggcctgcgcttcggtgaacgcccgcggcatatggttttcgagttcgagataatcggcaagttccgcaataaagtgctgaatttcacgcgccaccgcggcacgaaacgccgccgacgtgccggagcgttcccgcagcagtagacgaaaagcattagggttattgccgataaattccataaaggtggacaccgacgtgcggatcacgctgccgcctttggcgatacgctgacgcgcctggcgcatcagctggcgcagcatcagcccgctttcatccaccatggtcaggccgagttcatccacatcgcggaaatggcgataaaaagaggtcggcgcaatacccgcctcgcgcgccacttcgcgcaggctgaggctggcaaaactacgctcagcgcttaattgactaaatgccgcttctaccagcgaacgccgggtgcgttctttttgttgcgctctaacgcccatcacgatgtctgaatccttccaaaggcccgatggcactataccagacaataaaactaatcggtttacattgctttgtgaatgattgtttacgggcagtttgtgctttggcttcgcaaaaaagcacaacgataattgggttaaagcggggcaaatgttatcattgtgtttattttgtgtataaaaacaggtgagtaataccatgtcacattcctgggattacgatgcaatagtgataggctccggcccaggcggcgaaggcgcggcaatgggtctggttaaacagggagcacgggtcgcggttatcgaacgctaccacaacgtgggcggcggctgtacgcactggggcaccatcccttccaaggcgcttcgccatgccgtcagccgtatcattgaattcaaccagaacccgctgtacagcgaccattcccgccttcttcgttcctcctttgccgacatcctcaatcatgccgacagcgtgattaaccagcagacccgcatgcgtcagggcttctatgaacgcaatcattgcgagatcctgcagggcaacgcgcattttgtcgacgatcatacgctggcgctggagtgcccggacggcacagtggaaacgctgaccgccgaaaaattcgtcattgcctgcggctcgcgcccgtaccatccggcagacgtcgattttgcgcatccacgcgtgtacgacagcgactcgatcctcagccttcagcatgaaccgcgccatgtgatcatctatggcgccggggtaatcggctgcgaatacgcgtcgatcttccggggaatggaggtcaaagttgatctgatcaacacccgtgatcgtctgctggcgttcctcgatcaggagatgtcagatgccctctcctatcacttctggaataacggcgtggttattcgccacaatgaagaatacgagcgcatcgaaggcacggatgatggggtgattatgcaccttaaatccggcaaaaagcttaaagcggattgcctgctctacgcgaacggccgcaccggtaacgtggactcgctggcgctggaaaacatcggtttacaggcggatggacgtggcctgctgaaagtgaacagcatgtaccagacggcgctgccgcacgtgtatgccgtcggcgatgtgattggctacccgagcctggcgtctgccgcttacgatcagggccgtatcgccgcgcaggcgatggtaaaaggcgaagccagcgcgcatctggtggaagacattcctaccggcatctacaccattccggagatcagctcggtcgggaaaaccgaacagcagctcaccgccatgaaagtgccttacgaagtggggcgtgcgcagtttaaacacctggcgcgcgcgcagatcgtcggcatgagcgtcggcacgctgaaaattctgttccaccgcgagaccaaagaaattctggggatccactgctttggcgaacgcgccgccgaaattattcacatcggccaggcgatcatggagcagaaaggtggcggtaacactattgagtactttgttaacaccacctttaactacccgaccatggcggaagcctatcgggtagcggcgctgaacggcttaaaccgcctgttttaacaggcggtcaaagtggccatccatagtggtacggatggcctctgccagttgctcatagcggctgcgcagcggtgagccagggcggtagaccaggccaatggtacgacgcggttccggcttaatgcacggcagatagatgacgccgtcgcgcttgcgctctggcggtacagagagcgcaggcagcaacgtaataccacttcccgccgccaccatattacgcagcgtttccagactggtggcacggaagtgcgtatcttcgtcggccccggcttcgaagcaaaagcccatcgcctgatcgcgcaggcagtgcccgtcttccagcatcagcagtttttcgcctgcgagatcgcccatcggtacgcgatcgcggttcgcccacgggtgatcctcatagatcgccagcatcatcggctcgtcaaagagcggcacttcaataaaggcttcactctcttttaccagcgccaggatcgcgcaatcaagcttaccgctgtccagttgcgtcagcagctgatgcgtctgggcttcgtgcagatacatttccagtttcgggaaggtctggtgcaacagcgggataatctgcggcagcagatacggccccacggtcgggatcaggccgatatgcagcgggccggacatggtttcgccctgctggctggccatctctttaagcacttttacctcacgcagcacagtgcgcgcctgatccaccagcagcagaccggactgggtaaagagtactttgcggctggtgcgctccagaagcatgacgccaagctcatcttccagtttacggatctggccgctcagcgtaggctggctgacatggcaggcatctgccgcgcggcgaaagtggcggtgttcagctaacgcaaccaggtattcaagatcgcgaatattcattcttcatcctccgacgccatgatagtccatggcgatagatagaatagcaatgaacgattatccctatcaagcactctgtacaataattagcaacagaaacgaggcggcatctcaaaaatcccttgaagccactcgcctcgttttgaaaatactaaagccaacgtgaactatttagcggaccatgggtccgcttttttttgcagcaaataatgagtcctttacttataaatctacggataatccgtaaaacccgcctctaattataaattagataaatattatcccgccaatatatatatttagtttaagttaaaacgttattctcttgaaatatatttatgcctgcataaaaatgccgccgtagttttttcaataactgatggaatagtgaacgatgaaattgaatatgatgacgcgatattttatcgcggcaggtctattggcctgcgccggaaacgcctttgcgctggaagcatggagcggtcaggaaggcggcgatactattgaagtgatttttgacagtaaagtgtataccaaccgctggtatgttaacgctgataattgcccgaaagatgcatccgcagataactgggaaaatccatggacttatgtccgcgatgccacgcccgcagaaataaacgaatatggcaatccgaccacctgcgacgctggcggtatcacgccggtcaattacgacgcattcagcgccgaaaagaattacgtcacgggcgatattgtcagctatggcgatgtgaattatcaggcgaaaagcgcggttccggcatattcctttacgccaggcgaagataatccatggcaattatataccccagttccggtgtggagttctactcaggtatataacaaaggcgatgtcgcgcaacttgacggccagtcctatgaagcgctgttttacaccgtgggagataatccctcgaatcccgctaaccagaacccgaccggtactaatggccgtccatggaagccattaggcccgaccgtcgaatatagcgaagcagaactgagcgccgcgccacaatatagcgccactgcgctttatgaagcgggtacgctggtacagttccagggccagccctatgtatcgcaggcgaaagtgaaagccgtatcgccggttgatgaaaacccctgggcgatctacaccgactggaccggcactaaagagcgtgtaggtacgccgaaaaatccgtggcccgctcacgtttacgccccctatgtcgatttcaccctgaattccattccggatctggcgaagctggcgaaagagcaaaacattacccattacaccatggcgtttgtggtggcgaaaagcggcgagcagtgtatcccgacctggggcaccgcctacagcatgcaggactacgcccagtacagcaaaatcaaagcgctgcgtgaagcaggcggcgatgtgatggtgtctattggcggcgcgaacaactccccgctggcggcagcctgtaagaacgacgccgatctgcaaaaacactattacgacatcgtggataacctgaacctcaacgtgctggacttcgacattgaaggcacctgggtcgccgatcacgaatccatccagcgtcgtaaccgtgtggtgaaagccacccaggatcaatggaaaaaagagggccgtaaagtcggcgtctggtataccctgccgatcctgccgaccggtctgacgccggacggtgtctacgtgctggaaaatgcgcgtgatgcaggcgtggaactggcaggcatcaacgtgatgaccatggactacggcaactcaatttgtcagtccgacggcaccgaaggccagaacattcacggcacctgcgccacctccgccatcgacaacctgtttaatcagctgaagaaaatctggccggcgaaatctgataaagagatcaacgccatgatgggcaccacgccaatgattggctacaacgacgtgcagggcgaagtgttctatctgtcggatgcccaaaaagtcatgaaggatgctactgaccgtaagctcggtatgattggtatctggtcaatggcgcgcgacaagccaggcgtaccgggtcaggtttctccggaacatagcggcatgacgccatcgcaggcacccgagtacgcttacagtaaggtattcgcgcctttcaccagcgtctctgacgagctggctgacggcgtacactcttttgaagctgtcaccacggcaagccagcgtagcgttgaaatcaacctcactaccgccgcgcagaagagccgtaaatttgtcgctttccacaatgcaggtgaaggcgataaatacatgggtcatacccagaatggttcggtgtactacggcagtaaacgcgtcagcggcaacgacactatcgtcacgctgcattactactacgcaccaaaagtgggcgatgtcattaccctggtggaagatgtaaaaggtgaagtgactgtactgaagaaattcaccattacagaagagatgattaagctcaaataacccgctgtgctaaaaccagaaccccgccggtggcggggttcttttttgttcagcccaggcgttgtcgggcatcggcaatcgcctgcgctacctgcgccggagagacgccgcctttcgccgcacgtttatcgaggcaggattgcagtgacaggatcggatagacatcctcgccaattacgctgctgaatttctgtaaatccgccagcggcagatcttccagtggtttaccctgggcaatggcttccactaccgcttcgccgacaatatggtgcgcctcacggaagggaacgcctttggcgaccagataatccgccagctcggtggcattcgcgtaaccctgctgcgccgcttcctggcagcgtggacgtttcacctgaataccgtccagcaccagagttgccatgtgcaggcagtccagccaggtatccagcgcgtcgaacagcccttctttgtcttcctgcatatctttgttatacgccagcggcagacctttcagggtcatcatcatgccggtcagcgcgccctgtacacgcccgcatttaccgcggatcagctccagcgcatccgggtttttcttctgcggcattaaggaggagccggacgtcacgcgatcggacaactccacaaaacctgcttcaccggtgttgaagaagatcagatcttcggcgaaacgcgacagatgcaccatgccgatggacgcgtcagacagcaactccagcacgtggtcacgatccgatacgctgtcgaggctgttacgggtcgccgacgcaaagcccagccagcccgccagctgttcacggtcgatttcataagctgtacccgccagcgcgccgcagcctaacggactgacgtccagacgctttagcgcatcctgcaggcggctttcatcacgggcgagcatctcgacataagccagacaccagtgggcaaaggtcaccggttgcgcacgttgcaggtgcgtataacccggcatcaccgcatcctgattcgcctgcgcggtttccaccagcgcagactgtaactggcgattcgcgccaagcagttcactcacctgctctttacaccacagtttcagatcagtggccacctggtcgttacggctacgcccggtatgcaattttttgcccagcgcgcccactttgtcgatgagtctgccttccacccagctgtgaatatcttcggcgtcgctggtaagaatttgctgcggatcgagacgcacttcctccagcagaatagtgagcgcatcttccagctgttgctgttcctgcgccgtcagcacgcctaccgttactagcgccttagaccaggccacagagccaacaatatcctgctccgccaggcgatagtcaaagcgcaaagagtcgttgaactgtttgaaccgttgatccgctgcctgagtaaaacgcccgccccaaagtgccataacattcttcctttctttatgaattctgccggatggcgctacgcttatccggcctacggtctgtaggcccggcaagcaacgcgccgccgggcattaaatcttacgccagcgatgtatgaaatcttacgccagaatacgggtgccaatcggcgtgccgttaaacagcgccggaagttgttccgcatgacgccatgacgcgatgtccaccggacggcccagcgtgcgggcggcatccagcgcggcgttcaccttcacgatcatgccatcggtaataattccctggtcgatcagctgctcagctttcgccgccgtcatttcggcaatgcgctgacctttaccgtcaagaatgccgctgacgtcagacagcaggatcaaatccgcgcccagggtcgctgccagcgccgtggccgcctggtcggcgttgacgttcattaactgcccgtcgtcggtcacgccaatggagctgaccaccggcaggaaaccgccgtccagcagagtgttgataagctttggcgagccaggttttgcatggccgacgtgacccagttcttcgtcgagctgcgtcacgctcacgctgtcgccatcgcccagatacagaccaacggaggcgatatgatgtttcttcgcccatgccagcagcgttttgttggcggtccccgccagcgcgccggtgatgatgtcgatctgatcggctggcgtgacgcgcaggccgtttttcttggtcaccggcaggttaagctgcttcatcagctcatccaccacgcagccgccgccgtgcacgataaccagcgggcgctgatgagactcacgataattgaccagcgccgtaaacaggcgctccagcgcttcttcgctatccagcagtacgccacccagcttgataattaatggattcatcattgcacccttaaataagagactgcgtttcagcatagccgaaacgaatgtttgcacactgcaccgcctgcgccgccgcacctttcaacaggttatcttcggtcgccaccacaatgagatgctgatccgacaccgcgaaaccaatatcgcagaagggtaaaccgactacgtttttcagcgccggaacgcctttgtcatacagacgcaccagcggtttatccgcatacgcctgctggaaagcttgcgcgatctgcgcgctgtcgacgcccggtttcaggcggcaggtaatagtttccagaatgccgcgcgggaagttgcccaggtgcggggtaaagatcacctctgcgcccagatgggtggtgatttccgggtgatggcggtgattaaacacgccatagggttgcaggctcacttcacagaaactgttggagatagcggctttgcgcccggcgccgctgacgccgctggtggcgttgatcaccggccattgggaaagatccagcagcccggcgtcgatcaacggcttcagcgacagctgcgccgccgtcgggtagcagcccggcacggcgatcagattcgcctctttcagtttatcggcgttccactccgccaggccatagaccgctttttccagcagatccggatgctgatgggtgaagccataatatttttcatagaacccggcatcgttaacgcggaacgccccggagaggtcgaacaccacgcagcccgccgccagaaattgcggcgcgaggtcatggctgacttcatgggcggttgccagaaacaccacgtccacgccgtcggtaaattcgctgatgtcggacatcggctgtaaaggcagatcgacaatgcctttcagctgcggatgcaaatcggagatgcgctttcccgcatcattgctttgcgctgacacggtcaaagcggttatgttcatatgagggtggcgattcacgtagcttacaagctcagcgcccgcataaccgctagcgcccacaatcagcgtattcaacatcgggttcctttacgatcaacgttattgtatttttattcacatttactgcatgaatattgatactatcacgacctaaggtgtgtcaacaatgaaaatgaatctaccgccatttatcgagatttaccgcgctctgatagccacaccgtctatcagcgcaacggaagaagcgctggatcagagtaatgcggctttaatcaatctgctgggcggctggtttggcgatctcgggtttaaagtggacatccagccggttcccggcacgcgcaataaattcaatatgctcgccagcgcgggccagggatcgggcggtttactgcttaccggacataccgataccgtgccgtttgacgatggtcgctggacgcgggatccctttaccctcaccgagcatgacaacaaactttacggcctcggcactgccgatatgaaaggcttttttgccttcattcttgatgcgctgcgtgacgtggatgtgacgcaacttaaaaagccgctctacgtactggccaccgccgatgaagagaccagcatggcgggcgcgcgctatttcgccgaacacgccgaaatccgcccggactgcgccattatcggcgaaccgacatccctgcaaccggtacgcgcccacaaagggcacatctcgaatgccatccgcattcttggtcagtccggccactccagcgatccggcgcgcggcgttaacgccatcgaactgatgcatgaatccatcggtcatattctgcaactgcgcgacacgctgaaagaacgctatcactttgacgccttcaccgtaccttatccgacgctgaacctcggccacattcacggcggcgacgcggcgaaccgaatctgcgcctgttgtgaactgcatatggatattcgcccgctgccgggcatgacgcttaacgatctggaagggctgcttaatgaagcgctggcgccggtgagcgaacgctggccgggtcgcgtcaatatcgccgagctgcacccgccgatccccggctacgagtgcccgccggatcaccagctggtcgaggtggtggaaaaactgctcggcacgcaaacggaagtggtgaactactgcaccgaagcgccctttattcagaccctgtgcccgacgctggtgttaggccccggctcaattaatcaggcgcaccagccggatgaatatctggaaacgcgctttattaagccgacccgggagctgatcacccaggtggtgcatcacttctgctggcattaattcttccccctcgcctcccggtgaggggtgatttttgtcacatctccataagctttacttatctgcaactgcgcctgttaactttcataaattgccgtcatttattcgtttgctgaaccgttttcgcagcaattgacgcacggggttttacgtggctttataaaagacggtgtcttatttccctgcagtcctgatacgtgaccagggttataacaaaataaaatgagatggggtgtctgggttaacatgaacgaacaatattccgctttgcgtagtaatgtcagtatgctcggcaagctgctgggagataccatcaaggacgcgctgggagagaacattctcgaccgtgtcgaaacgatccgtaagctctcaaaatcctcacgtgcaggtaacgaagccgaccgccaggcgctgctcaccaccttgcagaacctgtccaacgatgagctgttaccggtggctcgcgccttcagccagttcctgaatctggctaataccgccgagcaataccacagcatatcgccaaaaggcgaaggggccagcaatccggaaattatcgcccgcaccctcagaaagctgaaagaccagcccgatctcaacgaagacaccattaaaaaagccgtggaatccctgtcgctggagctggtgctgaccgcccacccgacagaaatcacccgtcgcacgctgatccacaaaatggtggaagtgaataactgcttaaagcagcttgataacaaagacattgccgattacgagcgtaaccagctgatgcgccgcctgcgccagctgattgcccagtcctggcatacggacgaaatccgtaaacatcgcccaagcccggtggacgaagccaaatggggctttgccgtggtggaaaacagcctgtgggaaggcgtcccgaattacctgcgcgagctgaacgaacagctggaagaaaatcttggctacaagctgccggtggattttgtcccggtgcgtttcacttcctggatggggggcgatcgcgacggcaacccgaacgtcacggcggagatcacccgccacgtcctgctgctgagccgctggaaagccaccgatctgttcctgaaagatattcaggtgctgatctctgaactgtcgatggtggagtgtaccgacgaactgcgtgaaatggtcggcagcgaaggcgcgcaggagccgtaccgctatctgctgaaagggctgcgcagccagttgatggcgactcaggcctggctggaagcccgtctgaaaggccagcgcctgccaaaaccggcaggtctgctgtccaataacgaacagctgtgggatccgctgtacgcctgctataaatcgttgcaggcctgcggcatgtcgatcatcgctaacggcgaactgctcgataccctacgccgcgtcaaatgctttggcgtaccgctggtgcgtattgatgtgcgtcaggaaagcacccgccataccgaagcgctgggcgaactgacccgctacctcggtatcggtgattacgaaagctggtcagaggccgataaacaggcgttcctgatccgcgaactcaattccaaacgtccgctgctgccgcgcaactgggagccaagcgatgacacccgtgaagtatttaacacctgcaaagcgatcgtcgatgcgccgcaaggatccgttgccgcctatgtgatctcgatggcgaaaacgccgtctgacgtgctggccgtgcatttgctgctcaaagaagcgggtatcggctttgctctgccggtcgcgccgctgtttgaaaccctcgacgacctcaacaacgccaatgacgtcatgacccagttgctgaatatcgactggtatcgcggcttcattcagggcaaacagatggtgatgattggctattccgactccgcgaaagatgcgggcgtgatggcggcctcctgggcgcaatatcaggcacaggacgcgctgatcaaaacctgcgaaaaagcgggcatcgcgctgacgctgttccacggacgcggcggctccattggtcgcggcggcgcaccggcgcacgcggcattgctttctcaaccgccgggcagcctgaaaggcggactacgcgtgaccgaacagggggagatgatccgctttaagtacggcctgccggatatcaccatcagcagcctgtcgctctacactggcgcaatcctcgaagccaacctgctgccgccgccggagccgaaagacgcctggtgccacattatggacgagctgtctgacatctcctgcgacatgtaccgtggctatgtgcgcgaaaacgaaagctttgtgccctatttccgttcggcgacgccggagcaggaactcggcaaactgccgctgggctcacgtccggccaaacgtcgcccgaccggcggcgtcgaatcgctgcgcgccattccgtggatttttgcctggacgcaaaaccgcttaatgctgcccgcctggctgggcgcaggcgcggcgctgcaaaaagtggtggaagacggtaagcagagcgaactggaagccatgtgtcgcgactggccgttcttctctacccgtctggggatgctggaaatggtgttctccaaagctgatttgtggctggcggaatactacgatcagcgtctggtgaaaccggaactgtgggcgctgggcagcgaactgcgcgaccaactggaagcggacatcaaagtggtgctggatatcgccaacgactcgcacctgatggccgacctgccgtggatcgccgagtccatccagttacgtaacatctataccgacccgctcaacgttctccaggccgaactgctgcaccgttcgcgtcaggcggaagaagaaggtaaagaagcagatccgtgcgtggaacaggccttaatggtcaccatcgccggtgtggctgccggtatgcgtaacaccggctaatctgcacggcctcccccgcccggtgacgcaacgttcaccgggcgatctccgggaaaaacatgtcatacgacctcagccatcaccttacccgattcgccgaagacgccgccctgttgcagcgcgtctggtttgctcgcggcgcagggccggttccggcaggggcattacagacggattttccgcggctggaaatcgtgctcgagggcgaaataacagacggtagtgaacccgctgtcatggcggaaaacgacgtgctctttatccccaccggtcactggaatgcgccgcagtgccgccagcccgccactctgcttaacatccactttgagaaacagtatttagttttcagcgtgcaacgccgggacggcgtccatctgcacaatctgtgtcacgcccaggtggcgcggcgcggcccgcgtaccggctctttattattgcagacgctcagtgaattacagatgcagccgcacgagcagcgcaccgcccgtctcacggtaagaagcctgctcagccactgcgccgatctgctgggcagccagatccagaccgcctcccgcagccaggcgctgtttgaagccatacgccattatatcgacgaaaattatgccgcgccgctgacccgtgagtccgtggcgcaggcgttctatatttccccgaactacctctcccatctgtttgccaataccggggcgacaggatttaacgcttatctgaaccagatccggctggaacatgcacgcatgttgctgaaaaattacgatctgaaaataaacgaagtggcccacgcctgcggctttgttgacagtaactatttctgccgcctgttccgcaaagccaccgagcgcaccccgtccgaataccgccgccagtatcacagccagctgaccaaaacgaacctgtgagccagctcgcatttctgaccgcagcttacatttgtccagtgtttggcagatttgacagatagcggcctgtcggccccggcttttatgctgatcgccatcgcaacttcagaaagctgacgaggtaaagcatggaactctatctggacacggccaacgttgccgaagtcgaacgcctggcgcgcatttatccgctggcgggcgtgaccaccaacccgagcataatcgccgccggtaaacagccgctgcgggaggtgttaccgcgtctgcaacaggctatcgggcctgacggcacgctgttcgcgcaggtgatgagccgcacggcggacggcatggtggcagatgcccgacagctgaatgacatcctgccgggcatcattgtcaaagtgccggtgactgccgaagggctggcggccatcaaaatgttaaaaaaagaaggcatcgtgacgctgggaacggcggtgtacagcccggcgcagggtctgctggcggcgctcgcgggggcaaaatacgtcgcgccctacgtcaaccgcgtggatgcgcagggcggcgacggtatccgtatggtgcaggagctgcaacgtctgctcgaacttcatacgccggacagcatggtgctggcagccagctttaagaccccgcgccaggcgctcgactgtctgctgaccggatgtcaggcgattacgctacccttagaggtagcgcaacaaatactcggtacgccggcagtagaggcggcgatcgagaaattcgagcacgactggcaaaccgcctttggcacgttaacgctgtaaaaggagtcaactatggaccacattattcaatcgccgggcaaatacattcagggggcagatgtgctcacccgtctgggagactatctgaaaccgctggcggaaagctggctggtggtcggtgacaaattcgttttaggtttcgcgcaggagacgctgcaaaaaagttttgatgatgccgacctgagcgccgatatcgtgccctttggcggcgaatgttcgcaaacggaaatcgaccgtctgcgcgcgctggctgaagaggcagactgcacggcggtgctgggcattggcggcggtaaaaccctggataccgccaaagcgctggcccactacatgcacctgccggtggcgatcgcgccgaccatcgcctcaaccgatgcgccgtgcagcgcgctgtcggtgatctataccgactccggtgaattcgaacgttacctgatgctgccgaaaaacccggatctggtgattgtcgataccaaagtggtggcgggcgcgcctgcgcgtctgctggccgccgggatcggcgatgcgctggccacctggtttgaagcgcgcgcctgcgcccgcagcggggccaccaccatggcgggcggacagtgcacccaggcggcgcttgcgctggccgagctgtgctacaacacgctgctggaacagggtgaaaaagccatgctggcggcggagcagcatgtggtgaccgccgcgctggagcgcatcgtggaagccaatacctatctcagcggcgtcggctttgaaagcggcggactggcggcggcgcatgccattcataatggtctgacggcgatcccggacgcgcaccattactatcacggcgaaaaagtggccttcggtacactgacgcagctggtgttagaaaacgcgtcggtggaggagatcgaaaccgtggcgtcgctgtgtcacagcgtcggcctgccgatcaccctcgcccagctggatattaaagccgatattccggcgaaattgcgccaggtggcgcaagcggcctgcgcggaaggggaaactattcacaatatgccgggcggcgccacgcctgatgaggtgtacgcggcgctgatcgtcgccgatcagtatggtcagcgtttcctggaagagtgggaataaaccggttgccgggcagtcatgcccggcgtttttggttacagcgacgggcgcacgcccagcgtatgacaaatggcatagctcatctcggcgcggttcagcgtatagaagtggaaatccttcaccccttcgcggcttaaaatcttcaccatgtccatggcgatattcgcgcccaccagcttacgggtttcggggtcatcatccagaccgttaaacatctgcgacatccatgccggaatacgcacgttggtcatgtcggcgaattttttagcctgtttaaagttcgagaccggcagaatgcccggaatgatttccacgtcgatgccggtcgaggcgcagcggtcgcggaatcgcagatagctttccacgtcgaagaaaaactgcgtgatggcacggttagcgccagcgtcgattttgcgtttcaggttcagcagatccgcctgcgcgctcttcgcttccgggtgcacttccggataggcggcaacggaaatatcaaaatcagcaacctcttttaacagcgcgaccaggtcggtggcgtacatatccggtttaccgccgcccggcggcagatcgccgcgcagcgccacgatatgacggataccgttgttccagtaatcccgggcgatgctgcgcagttcgtcacggctggcgtcaatacaggtgagatgcggggccgcttccagaccggttttatctttgatgcctttaataatgctgtgcgtacggtcgcgctcgccggagtttgcgccataagtcacggagacaaatttcggcttcaggctgctcaggcgatcgatggagtgccataaagtctgttccatttcactggtgcgcggcgggaaaaactcaaaagagacattaatctgcccctgcacttctgccaggctctgattcagggcttcccgctggttggcgtgaaaaaagctcataccttacctcatcaatcgcgtgtcgttgtttattgtaatgtgaacttctatacgtttagacgtccagatgtaaaaatgacggaaaagcgatatggcgtcaacagaattatcgtgaaactgtgtgaggattgttcagggaagatgaaaaagattcaggatggaaagccccctcactctggcagtgagggggataaaaactacagcagttgcgccaggcgattgatgtctgactggatcgccccggcggtcacatcgcgtcccgcgccaggcccgcggatcaccagcggattatcgcgataccagcggctttcgatggcaaacacgttatcgcacggcagcagggccgccagcggatgttcagggcgtaccgcttccacgccgacgcgcgcttttccgttagcgttgaaacgcgccacgtaacgcagcacgaggcccatttcccgcgccgcttccagccgctgcaccatctggtcgttcagctcatcgccgttctcaaagaagtgatccaccgacccctcttcacagccgttcggcaccagcgactccacgcgcacctgatccggttcgatgtcataacccgcttcacgggcaaggatcaccagcttgcgcatcacgtctttaccggagagatcgacgcgcggatccggctcggtcagcccctgctgccaggcctgatccaccagctcggtaaagggtacggtgccgtcaaattgcaggaacagccaggagagcgtgccggagaaaataccgctgatagcgagaatggcatcgccgctgtcgatcagatcgcgcacggtatggttcacgggtaagcccgcgcccacggtggcgttatacagccagtgacggccggttttttcgaaggcgtcatggatctggcggtatttgtgactgtcgctcgctccggccagtttattggcgctgataacgtgaaaaccgtggctggcgaagtccagatactgatcggccagctgttcgctggcagtcacatccagcaccactaaatcatcatagggatgggcgcgcatccacaggaacagcgactcctcatcctgttcgaccgcttcatcgttaaagaacgccagcgcgcggctggcatccagcccctcatagctcagcaggctgcggcggctgtccaccacgcccgccagcacaaattcaaaaccggtccgcgccgacagcgcgccctgttcacgggcgaacagctccagccagcgcgagccgatattgcccttgccgaacagcatcagaccgatacgtttttccgcgcggaacagcgactggtgcagcccctggatcaggctctccgtcggcccggcgcgcagcacggccaccaggctgatgctgtcgtcggactgccagataaactctaccggctgaccctttaattgctgccagaaacgatggctgtgcagcggattacggcagacgcccgccccgaccagcgccaccagcgccagcccctgacgcaggcgcagttcaccggtcagcccggcgtcctgcaacagcttcagcgcgctgtcgaccacttccgaggtgtagcaaagttgcagcaggttgcgatcgttatgaatgccgaccgccagcggacgcagctgcgcgcgcttgaggatcagatccacctctttatgggccagcgcgaaatcctgactggcgggcacctggaactcaatcaggcagacgtcatcatgactggtgacaatacgcgccccggtgccggatgccagcacgcgctcaatgcgcgtggagccctgctccgggttgtagctgcaacgcagttgcagatcgatgtcgctggcggaaaccggttgtaaggtacgggcgtgcagcaccggcgcggccagacgcgccagttcgctggcttcatcaaggcgcagcagcggcagcaggcaggcatcttttactttacgcgggtcggcgctgtacaccccggccacgtcgctccagatggtcacgcgggacacgccgcccagcgcgccgatttgcgtcgccgagtagtcggaaccgttacggcccagcagcacggtttcccccgcatcgttgcggcagataaagcccgtcaccacggtacgtttattgggatgctgcgccagcagttgctgcaacagcggataggataagccttcattgacctgcggttgcgggccgcgctcggcgcgcaggaagtcgcgcgcatccagccaggcggattccataccctgtaaattgagcaccgcagacatcaggcgcgccgaccagatctcaccgtgccccaccacttccgcatacaccgcgtcggtgatgccgctgtcaagcagcgccgccagtcgctccagatcgtgaataaacgcctgggtgagcgtgtcggccatatccgcaggcagcagaccgccgatcagatcgctttgatagcgacgcagcgcctgttgaacctgatgcgcagagagcctgtcggtctggcttaacttcagccagctgatcaactggttggtggtgctgcccgccgccgagacgaccatcatgtcgccaggctgcgaatattccgccatgatacccgccacacgcaggtaacatttcacgtcagccagactactcccaccaaacttatgcagttgacgacctttcgcccctgcctgcgcaatcacactcatgtttaccccttgtttgctgcccggaagccattttccaggtcggcaattaaatcttcgccatcttcgatgccggtggaaatacgcagcaacgtctcggaaatacccgccgcggcgcgcgcttctggcgccatgcctgcgtgtgtcatggtggcggcgtgggagatcaaactttcaactccccctaacgactccgccagcgtaaacagtgacagcccgcttaagaaacgacgtaatgtttgttcatcgccatccagttcaaaactgagcatggcgccaaatcctttttgctgacgggcagcaatctcgtggccctgattttccggcaacgacgggtgatacagttttttcaccagcggctgtgttttaaggaaatccacaatcccctgggcattgcgttgcgccacttccatgcgcggcgacaacgtacgcagcccgcgcagcagcagatagctgtcaaaggcgctgccggtgacgccgatattattcgcccaccatgccagttcagtgacagtcgcctcgtctttggcgatcaccacccctgcgaccacgtcagaatggccattcagatatttagtgcatgaatgtaaaaccagatcggcacccagcgccagcgggttctgcaatgccgggcttaagaaggtgttatccaccacgctgacggccccggcttcacgcgcaagctgacagattttcgcaatatccacaacgcgcaacaatgggttgctcggactttccaccagcaccagtttcggtttttcggccagcgccgattttaatgcctgctcgtcgccctgatcgacaaataaaacgcgataacagccgcgttttgccagactgtcgaacaggcggtagctgccgccgtagcaatcgtgcggcgcgaccagcagatcgccgggcttcagaaagacagtggtcaccaggtggatcgccgacatgccggtattggtcatcaccgcgcccgcgccgccttccagttccgccagcgcgcgctgcaccacatcccgcgtcgggttaccgcgacgggagtagtcatgggctcgcggttcgttaaagccggtgaagttataggtactggagagatgaatcggcgggacaacgcaaccgtactgctcgtcatcattcaatccgctacgcactgcgatggtggcctgtttacgcgtcatgtgaaggcttcctggcttaagggatgaaaagtcagccatcagaatagcattgtgaatatggacgtcaatacatctggacatctaaacttctttgcgtatagattgagcaaatgcataatagccgttaaaattatatgcgttagcgcatatccgccgattcgatactccgtgtcacggtgtcgtctctacggtaaactacgcgagattacggtgcggtacctgcgtttgatcaggtttcgaccttttactaatgactgagaggattaaaggtatctcatggctgaatggagcggcgaatatatcagcccatacgctgagcacggtaagaagagtgaacaagtaaagaaaattacggtttccattcctctgaaggtgttaaaaatcctcaccgatgaacgtactcgtcgtcaggtgaacaacctgcgtcacgccactaacagtgaactgctgtgtgaagcgttcctgcatgcctttaccggtcagcctttgccgaacgatgaagacctgcgtaaagagcgcagcgatgagatcccggaagcggcgaagatcatcatgcgtgaactgggcatcgacccggatacgtgggaatactaagcaataaaaaagggcagaagatattctgcccttttgttttggcccgaatttcaggcataaaaaaaccgcccgcaggcggttctttctggcagccaatacttatttgctgctgcctggcaggctgaagcgcttgttgaagcggtcaacacggccaccggtagcaacgtcacgctgcttgccagtatagaacgggtggcatttgctgcacacgtccaggttcagatcgtgacccacggtagaacgggttttgatcacattaccgcaagaacagtttgcagtaatttcaacataattcgggtgaataccttttttcatgggagaaacctcagtttaaggccgcgtcgctcttccagccctaacgccagacaccacgcgatgtttaaagtagttacgttctctttgacgtgatcaaaacacatcaaaggcggcgaatcatacagaaaataaccagcgcatgcaaactgatccgcgccttctctttctaatgtgtatactaacccgccagttttcaagccaggatgattcgatgcccgtcgctcacgtagccctgcccgtcccgctgccccgtacgtttgactaccgcctgccggaaggcgtcgccgtcaacgcgggctgtcgcgtgcgcgtgccctttggtaaacaggagcgggtcggcattgtggtgtccgtcagcgagacaagcgaactgccgctggatgagctgaaaagcgtcgtcgaggtgctggataacgatcccgtgttctccccgtctgtatggcgattactgctgtgggccgctgattattaccatcatccgctcggagatgtgctgtttcacgctttgccggttttgctgcggcagggcaagcccgccagcgttgcgcctctgtggttctggttcgccaccgaacagggccaggcggtagacatcaacagtctgaaacgctcgccaaaacagcagcaggcgctggcggcgctgcgccagggaaaaatctggcggcatcaggtgcaggatctggaatttaacgatgcggccctgcaggcgttgcgcgccaaaggcctgtgcgatctcaacagcgaagccccggcgctgaccgactggcgggaaaattacgccgtacccggcgagcggctgcgtctgaataccgagcaggctaccgccgtgggcgccatccacagcgaatctgacaccttttccacctggctgctggcgggcgtcaccggctccggtaaaaccgaagtctatttaagcgtgctggaaaatgttctcgctaagggaaaacaggcgctggtgatggtgccggaaatcggcctgacgccgcagaccattgcccgctttcgcgaacgttttatcgcgccggtggaagtgctgcactccggccttaacgacagcgaacgcctgagcgcctggctgaaagcgaaaaacggcgaagcggcgattgttatcggcacgcgttcgtcgctgttcactccgttcaaaaatctcggcgtgattgttatcgacgaggagcacgacagctcctataaacagcaggaaggctggcgttatcatgcccgcgacctggcagtctaccgcgcccacagcgagcaaatcccgattattttaggctcggccaccccggcgctggaaacattacataatgtacggcagcgcaaataccgtatgctgcgcctgacgcgccgggccggtaatgcgcgcccggccacgcagcatgtgctggatttaaaaggccagccgctacaggcaggactggctccggcgctgatcgcccgtatccgccagcatgtgcaggcggataatcaggtgatcctgttcctgaaccgccgtggctttgcgcctgcgctgctgtgccatgattgcggctggacggcggagtgcccgcgctgcgatcactactacaccctgcaccaggcgcagcgccatttgcgctgccaccactgcgacagccagcgcccggtgccgcgccagtgtccgtcctgcggctccacgcatatggtgccggtgggtctgggcaccgagcagttagagcaggctctagcccccttctttcccggcgtgcccctgtcgcgtatcgaccgcgataccaccagccgaaaaggcgcgctggagcagcagctggcggaagtgcatcgcggcggcgcgcggattttaatcggcacgcagatgctggcgaaaggccaccatttcccggacgtgacgctggtggccttgctggacgttgacggcgcgctgttttccgccgattttcgcgccgccgagcgcttcgcccagctctatacccaggtttcaggccgtgccggtcgcgccggcaagcagggcgaagtggtgctgcaaacgcaccatccggaacatcctttattacagacgctgctgcataaaggctacgacgcctttgcggatcaggcgctggccgagcggcatacgctgcaattgccgccgtggaccagccatgtgattattcgtgccgaagatcataacaacgagcaggcgccggttttcctgcaacagctgcgcaatctgttgcacgccagcccgctgctggacaacaacacctggattttagggccggtgcccgcccttgcgccaaagcgcggcggtcgctaccgctggcaactgctgttgcagcatccgtcacgcgttcgcctgcaacatcttatcagcggcgcgctggtgctcatcaatacccttccggaagcgcgcaaggtgaagtgggtgctggatgtcgatcctatcgaaggttaaggttgcgaggcggatcgtataattcaacatccgtcacacttttcatgaaaatactgtaaccggaacgggtaactatctgataaaaatgtgtctgatgtcagacacagaggatgtggctgcgcctgcgtctggatgcgaggagaaagaggtgaaggctaagaaagaggttgctgccgcgaccatgaaagacgttgccgagaaagcgaaagtctctacggcaacggtgtcccgcgcgttaatgaacccggataaagtctcgcagtcgacccgcaaccgggtggaacaggcggcccttgaagtgggctattatccgcaggcgatggggcgcaacgtgaagcgcaatgaatcgcgcactatcctggtgatcgtgccggacatctgcgatccattttttagcgaaatcatccgcggtattgaagtcacagcggcggaacagggttatctggtgctgatcggcgactgcgcccatcagaatcaacaggaaaaaacctttatcgacctgatcattaccaagcagatcgacggtatgctgctgctcggctcgcgcctgccgtttgacgccagcatcgaagaacagcgtaatttaccgccgatggtgatggcgaacgaattcgcccctgaactggaattgcctaccgtgcacatcgataacctgacggccgcttttaatgccgttaattatctgcgcgaacagggccatcagttgatcggctgtatcgccgggccggaggagatgccactgtgccattatcggctacagggctatgtgcaggcgctgcgccgcaccgggatcaccgttgatccgcactatattgcccgcggcaattttacctttgacgcaggcagcgcggcgatggagcaactgctggcgctaccgaagccgccgaccgccgtattctgtcacagcgatgtgatggcgctgggcgcgttatcctgtgcgaaacgtcatggcctgaaaattcctgacgatctgtctattattggtttcgacaatatctcgctctcccagttttgcgatccgccgctgaccacagtgtcgcaaccgcgcttcaaaatcggacgtgaagcgatgctgcttttactggatcagcttcacgggcaaaacgtcagcagcggttcgcggctgctggactgcgagttaatcatccgtgggacgacacaagccgttacctgaagtaataggctttaagactcccgcttctggtcaaagccccgtcgcttaagtaacatgacgggctgacaaacgaataaatacagcgaaacgatagtggcacaacgagattatgtacgccgcagccagtcggctccttcgcggcgaaaaaagagcacgtcaaagaaaaaacaacgtagcccgtctgttgtatcgcccgccatggttgccattgcggccgctgtgctggtggcgtttatcggtggtctgtactttattacgcaccataaaaaagaagatgcagagacgctgcaaaatcagaaggttgcagggaacggactgccgccaaaaccggaagagcgctggcgctatatcaaagagctggaaagccgtcagcctggcgtacgcgcgccgacagagccgtctgccggtggcgaggtgatgaacccgagccagctgacggacgagcagcgccagttgctggagcagatgcaggcggatatgcgtcagcagccgactcagcttaatgaagtgccctggaacgaacagacggcggaacagcgtcagcaaaccctgcaacgccagcgtcaggcgcagcagcaggttcagctacgccagcagcaacagcaacagcagacatacacgcagccggtgcagcagccgagaacgcagccccgggtaacggaacagccgtatcagcaaccgcgcacggtgcaaaccgcgcccgcgcagactaagccggtacagcagcagccgaagcagaccgcttcccagcagccttatcaggatctgctgcaaacgcctgcgcataccgatgccgcgccgccaaaacagcaggccgcgccgatcacgcgtgagccggaagcgccgaagaaaacggcagagaaaaaagatgagcgtcgctggatggtgcagtgcggttcctttaaaggcacagagcaggcggaaaccgtgcgcgcgcagctggcgtttgaaggcttcgactcccgcatcaccaccaataacggctggaatcgcgtggtcatcgggccgatcaaaggcaaagataataccgacggcactcttaaccgcctgaagatggcgggccactcaaactgtattcgtctcgcctccgggggttgaaacccccaaaatcccccccatctataattgcattcagccccgtacactgtgcggggcttctaatccgtttatgcaacaaggggtctgctcgtgacaacaatcgtaagtgtacgccgtaacggccaggtggtaattgctggcgacggccaggccacgctgggcaacaccgtaatgaaaggcaacgtgaaaaaagtgcgtcgtctgtacaacgacaaagtaatcgccggttttgcaggcggtactgccgatgccttcacgctgtttgaactgtttgaacgcaagctggaaatgcaccagggtcatctggtgaaagccgccgttgagctggcaaaagactggcgcaccgaccgcatgctgcgcaagcttgaggctttgctggccgtggcggatgaaaatgcgtcgctgatcatcaccggtaatggcgatgtggtgcagccggaaaacgatctgatcgctatcggatccggtgggccgtacgcccaggccgccgcccgcgcactgctggaaaataccgacctcagcgcgcgcgacattgctgagaaggcgttgggcattgcaggcgatatctgcatctacaccaaccacttccataccatcgaagaattgtcctctaaggcgtaaggatctctaatgtctgaaatgaccccacgcgaaattgtcagcgaactgaataaacacatcattggtcaggataacgccaagcgttccgtggccattgccctgcgtaaccgctggcgtcgtatgcagctcgacgaagagctgcgccatgaagttaccccgaaaaatattctgatgattggcccgaccggcgtcggtaaaaccgaaatcgcccgtcgtctggcgaagctggcgaacgcgcctttcatcaaagtggaagcgaccaaattcaccgaagtgggctatgtgggtaaagaagtggattctatcatccgcgatctgaccgatgccgctatcaagatggtgcgcagcaactccattgaaaaacaccgctaccgcgcggaagaaatggcggaagagcgcattctggacgtgctgatcccaccggcgaaaaacaactggggccagcctgaacagcagcaggagccgtccgccgcgcgccagtccttccgcaaaaagctgcgtgaaggcgagctggacgacaaagagatcgaaatcaatctctctgccgcaccgatgggcgttgaaatcatggcccctccgggcatggaagagatgactagccagttgcagtccatgttccagaacctgggcgggcagaagcagaaaccgcgtaagctgaaaatcaaagaagcgatgaagctgctgattgaagaagaagcggcgaagctggtgaacccggaagagctgaagcaggacgccattgatgctgttgagcagcacggcatcgtgtttatcgatgagatcgataaaatctgtaagcgcggcgaatccaacggcccggacgtttcccgcgaaggcgtgcagcgcgatctgctgccgctggtggaaggctgtaccgtctccacgaaacacggcatggtgaagactgaccacattctgtttatcgcctctggcgcgttccaggtggcgaagccgtcggatctgatcccggaactgcagggtcgtctgccgatccgcgtggaactccaggcgctgaccacggaagatttcgaacgtatcctgactgagccaaacgcgtccgttaccgtgcagtacaaagcgctgatggccaccgaaggcgtgaacatcgacttcaccgaagatggtatcaagcgcatcgcgcaggccgcctggcaggtgaacgaaaccacggaaaacatcggtgcccgccgtctgcatactgtgctggagcgtctgatggaagatatctcctatgacgccagcgatcgcaatggtgaatccatcactattgatgcggcttatgtgagcaaacacctggatgagctggttgcagatgaagatttgagccgttttatcttataatcgcgcgcactgcactttcatcactgttgatggggctgaatagccccatttttattggctaaaaactatgactgactcgcgccctttaagccgcacccaggcctggctggaaagcctgcgtccgaaaactcttcctctggccttcgccgcgattgtggtcggcacaacgctggcctggtggcaggggcattttgatcccctcgtcgccgtgctggcgctgatcaccgccggtctgctgcaaatcctctccaatctggcgaacgattacggcgatgcggtaaaaggcagcgataagcccgaccgtatcgggccgctgcgtggtatgcaaaagggcgcgatcacccaggcgcagatgaagcgggcgctgatcgtaacagttatcctgagcgcgctgtccggactggcgctggtcgccgtggcctaccagacgctggcggattttgtcggcttcctggtgctgggcgggctgtcgattatcgccgccatcacctataccgtcgggcgtcgtccctatggctacattgggctgggcgatatttccgtgctgctgttctttggctggctgagcgtgatgggaagctggtatttacaggcgcacacgctgatcccggcgctgttcctgcctgccacggcctgcggcctgctgtccaccgcggtgctgaacatcaataatctgcgcgatattaacagcgatcgtaccaacggtaaggacacgctggtggtgcgtctggggccggtgaatgcccgccgttatcacgcctgcctgctggcgggcgcgtggctgtgcttcgccctgttcaacctgatttcactgcaaagtctgtggggctggctgttcgtgctcgccacgcccgtgctggtaaaacaggcgcgctatgtactgcgtgaaaccgaagcgagcgcgatgccgccgatgcttgaacgcaccgtaaaagccgcgcttttaactaacctgttgtttgtagtcggtatagtgctaagtcagctggcggtttaactgacaaatatcaattaacaattgatgattttgccaacaacgcgttatgcacgatatactgacaactctcgcggcaactgaacgtaaatcctatgaaatatgatacttctgagctttgtgacatctaccaggaagatgtcaacgtcgtggaaccgctgttctccaactttggtggacggtcgtcttttggcggacaaatcatcacggtcaaatgtttcgaggacaacgggttgctctatgatctgctcgaacagaatggtcgtggacgcgttttgctgatcgatggcggcggttcggtacgtcgtgcattaattgatgcagaactgggacgcctggccctgcaaaacgaatgggaaggcattgtggtctatggcgcagtacgccaggtagacgatctcgaagagctggacatcggcattcaggccattgccgctattccggtaggcgcaaccgcagaagggattggcgaaagcgacatccgcgttaattttggcggcgtgactttcttctccggcgaccatctctacgccgataacaccggcattatcctttccgaagatcccctggatatcgagtaaataaaaaaggccatcgttacgaccgatggcctttaatttcaggtgttatcattcgtctcatagtaaacgatacgtaattcatatttcccatcggatgatgtagtaaagacactcatgatggcattatcatcgtaataattatctataaagttctcgagttgttctaacctcacatcaatttcaggttttgggatctctttaaaaataagctcgcttttttgaagaccatttacttcctgtgcatgcacaataaagtaccatttatctgttacgcgtggtgctttctttaatggttctggcgtcaataagagatagcgaaagtaatcctgttgtgtatattcttcatctgaaaatactcttgtcattgaatagcaataaaaaagtgcaagtgatactatgaaaaaaacagctaatatcaacctgagttttttcatcagaaaatctctcttatccactctgggtttgccacaggctttattgtattcataaatgctggtaagtgtcccggataaggctgatgctttactttcttatctataggatccgggaaaatgagaggaagtacacttttgtttttaaattcccccacggggccatagtagtcccagatacgataagctttctctttagggcaaatatcaagcaatggagtgtaatccgtacaatctacagcctgatagaaaccaaaaagatttgagaccaggtcctcagcgctaaaaccgctatctgttaccagaacatagggccaaaaatcttgtaaggtttcaaattggcgggaagtacccatgaatatcgatagcgccactcctttcaaatcgcgatcattcaatcctctgcgtactaaaaatcgtctatatatacccgtgacagcatttataccatagatgctttttttcatatcctgataatagttgacttcaaagtattgattattaccaccacgtggcattgccatttgatgccagagtctttctgcaccagaggggtttgcatgtcctaaatcaatccaacctaagttttctgtatagattaaccccgacctaatttccctcgtaatatatcgatccatattatcaataatgtcagctctctttgtcatttcacattccttgagaaattaaagagttcatactactactttagaaataaaaaaagcatccaaaggatgctttttttagtgaagataaatcagacttcttccatgcggcctaataaagcctgcagacgatcctgccagccggactgctgttctctcagttcgtggttctcacgctccagctgctcgcgggagtgctgtgcggactgcatttcctgtgacagcgagttgttcttttctttcagctcttcgatttccatctgcagcagggtgatggtatcaatcgcctgctgtactttcgcttccagcttctcaaacacttctaatgacatagtcatacctctcctgaattccgatttgcaaggcgacgcccgtttcaacgcgcactctatccccccgattgtatggagcgaccacgcgcctgtccagcgacaacccttgtagatcgcgctttgcaacacttttaagcatatacctggtgcgtttggcgaaactacccctaaattgttaacgcattcgttaatgaaatgattcagctcacttttcgagctgctgttaaaacgcgctttatagcgcgaaaacgctcattttattgacggagtacacacattttgatttcgatatttctcgtttttgctcgttaacgataaattaacaccgtgtctacagggcatcgtgactgtcattgagtcgcgctaacaataaccattacactcttcaggatccgattatgagtcaaacatcaaccttgaaaggccagtgcatcgccgaatttctcggaaccgggttgttgattttcttcggtgtcggatgtgtcgcagcgctgaaagtggcaggcgccacttttggacagtgggaaatcagtattatctggggtctgggcgtggcgatggccatctacctgaccgcaggggtttccggggcacatcttaatccggcggtaaccattgcgttatggcgatttgcctgtttcgacgggcgtaaagttgtaccatttatcgtttctcaatttgccggcgcgttttgcgcagcggcgatcgtttacgggctttattacaatcttttcatcgactttgagcaatcgcatcagatggtgcgcggtagcgtcgaaagtctggatctggcaggtatcttctcaacttatccgaatccgcatatcaattttgtgcaggccttcgcggttgaaatggtgattaccgctattctgatgggcgtgatcatggcgctgggcgacgatggcaacggcattccgcgcggcccgctggctccgctgttaatcggcctgctcatcgcggtgattggggcatccatggggccgctgaccggctttgcgatgaacccggcgcgtgatcttggtcctaaaaccttcgcctggcttgccggctggggtgacgttgccttcaccggcggcaaagatattccttacttcctggtgccgctgtttgggccgatcgtgggcgcgtctctgggtgcgtttggctatcgtaagctgattggccgccacctgccctgcgatacctgcgtagtggaagatgagaaggctccggccagcgccactgcacaacaaaaagcttcgctgtaatgtgactacgggacaaaattatgactgacaaaaaatatatcgttgcggttgaccagggaaccaccagctcccgtgccgttgtaatggatcacgacgccaatatcatcagtgtcgcgcagcgcgaattcgaacaaatttatccaaagccaggctgggttgaacatgacccgatggaaatctgggcgagccagagttcaacgctggtggaagtgctggcgaaagctgacatcaacgccgatcaggtggccgccattggtatcaccaaccagcgcgaaaccgctatcgtatgggataaagagaccggcaagccgatttacaacgccatcgtctggcagtgccgtcgtacttccgacatctgtgagcatttaaaacgtgatggcctggaagattacgtgcgtaaaaccaccggtctggtgatcgacccgtacttctccgggaccaaagtgaagtggatccttgaccacgtggaaggctcccgcgagcgtgctaagcgcggcgaactgctgttcggcaccgtcgatacctggcttatctggaaaatgacccaggggcgcgtgcacgttacggattacaccaacgcctcccgtaccatgctgttcaacatccacacgctggaatgggacgccaaaatgctggaagtgctggatattccgcgggaaatgctgccggaagtccgcaaatcttcagaagtgtacggccagaccaacgtcggcggtaaaggcggcacccgtattcctatcgccggtatcgccggtgaccagcaggcggcgctgttcggccagttgtgcgttaaagaagggatggcgaaaaacacctacggcaccggctgctttatgctgatgaacacaggcgaaaaagcggtggcgtccgagcacggtctactgaccaccatcgcctgcggtccgcacggcgaagtgaactatgcgctggaaggcgcagtgtttatggcaggtgcatccatccagtggctgcgtgatgaagtgaagctgatcagcgatgctttcgattccgaatacttcgccaccaaagtgaaggataccaacggcgtgtacgtcgtgccggcctttaccggtctgggcgcgccttactgggacccttatgcccgcggcgcgatcttcggcctgacccgtggcgtgaactctaaccacatcatccgtgcgacgctggaatccatcgcctatcagacccgtgatgtgctggaagcgatgcaggccgactccggtattcgtctgcacgccctgcgcgtggacggcggcgcggtggctaacaacttcctgatgcagttccagtccgatattctcggcacccgcgtggaacgtcctgaagtgcgtgaagtgacggcgctgggcgcagcttatctggcgggcctggcagtgggcttctggcagaatctggatgagctacaggaaaaagcggtcattgagcgtgaattccgtccgggcatcgaaaccactgaacgtaactatcgctacagcggctggaagaaagcggtgaaacgcgccatggcgtgggaagagcgcgacgagtaattttcccctcaccctaaccctctccccatgggagaggggattattcggtgccccgttcctgcccttcccctctccctcagggagagggccggggtgagggtggtatctcctctctctgtgttaaacttcaggcaatttctttcttaaacgagtctgtaatgaaacgagaacttgccatcgaattttcccgcgtaacggaagctgccgcgctggcgggctataagtggctgggccgcggcgacaaaaacgttgccgatggcgcagcggtacacgccatgcgcatcatgcttaatcaggtcaatatcgacggcaccatcgtgattggcgaaggtgaaatcgacgaagcgccgatgctctacatcggtgaaaaagtcggtaccggcaacggcgatgcggtggatatcgccgtggatcctatcgaaggtacccgcatgacggcgatgggccaggccaatgcgctggcggtgctggcagtgggcgataaaggcaccttcctgaacgcgcctgacatgtatatggaaaaactcattgtcgggcccggcgcgaaaggcgccatcgatctcaacctgccgctggaacaaaacctgcgtaacgtcgctgctgcgctgcaaaaaccgctttctgaactgacggtcaccattctggcgaaaccgcgccacgacggcgtgatcgcggaaatgcaaaagctcggcgtgcgcgtgttcgccattccggatggcgatgtcgccgcatccattctcacctgtatgcctgacagcgaagtggacgtgctgtacggcatcggcggtgcgccggagggcgtggtgtcagccgcggtgatccgcgcgctggacggcgacatgcagggccgtctgctggcacgtcacaccgtcaaaggcgacagcgaggaaaatcgtcgcatcggcgagcaggagctggcgcgctgcaaagcgatgggcattgaggcaggcaccgtgcttcagctggatgatatggcgcgtaacgacaacgtgattttctcggccaccggcatcaccaaaggcgatctgctggacggcatcacccgtaaaggcaatatggcgaccaccgaaacgctgctgatccgtggcaaatcgcgcaccattcgccgcattaaatccattcattatctggatcgtaaagacgtggacgtacagcgacatattctctgaaatcatttgatcaaatgagctttccggcccctgcgggctggaaatgtcagggttgagaaacgaagataaggcatcgcatcagaacaggagataatcatggcggattgggtaacaggaaaagtcgtaaaggttgaattctggaccgatgcgctctttagtctcaccgttcatgcccccgttaatcccttcactgccggtcagtttgccaagctgggactggagattgacggcgagcgcgtacagcgcgcctactcttatgtcaatgccccttccgatcccgatctggaattctatctggtcacggtgccggacggtaagctcagcccacggctggcggcgctgaaacccggtgatgaagtgctcatcgtggccgaagccgccggtttctttgtgcttgatgaagtgccggactgcgacactctgtggatgctggcgacgggtacggcgattgggccttatctgtcgatgttgcaggaaggcaaagggctggagcgctttaaaaacctggtgctggtgcacgctgcgcgttacgccgcggatctcagctatctgccgctaatgctggagctgcaaaagcgctacgaaggaaaactgcatatacagacggtagtcagccgtgaaacggtttccggctcgctgcacgggcgcgtaccggcgctgattgaaagcggagaactggaaaaagccgtgggactgccgatggataccgcgaccagccacgtgatgctgtgcggtaatccgcagatggtgcgtgatacccagcagttactgaaagatacccggcagatgaccaaacatttgcgtcgccgtccgggtcatatgaccgctgagcattactggtaattaacggaacttcacgtccagcgtgtctttgccgaacttattttcgccctgggtgcccacaaacgcgcccaggtcgatcaagagcattaccatgatcagcgtcggaatgaagcgtccgaccgcccagacccagacgccgcccagcaccgcccagttcccggccagtaagatccacgctaccaccatcagtaacgcccacaggccggatttattgcgatcgtgcagccgcttgacggttacgcatgccgtcggccatatcaggcacaccagcgcaaaagcggccatttgcagatccatcagtcctttaccggcgagcgtaaacagcaacaccatggccagcgcccagagcgcgatccagatccagaagtcacgacgcccaatacgtcctttaaatgagaataaccactgctgtatggtcatgtaaggttccttataatcgtaatgccgcgtagtttaccctgatcagcgccgtttttgacaagcgggacggttatcgttttaatcggcaacacattgcacagaggacgatgttgatgaagatacgggatttacgggtttgcctgttgctttccctgctgctgaccagcctggcaggccgcgccgtggacgcgccgctggcggcaacggccccttacctggtgacgggcgcgcccacctttgatctctctatcagcgcgttccgggaaaaatttaataccgccaacccagggcttacgctgaacgagtttcgcgctatagattcgcgtaccgatcgcgccagcctgacgcgggccgccagcaagattaacgataatctctatgcctcaaccgcgctggagcgcggcacgctgaagatcaaatcgatgcagatcacctggctgccgatccgcgggccggatcagaaagcctcgaaggcgaaagcgcaggaatatatggccgccgtcctgcgcgttttcactcccacgttgaccagcgcgcaaagtctgcaaaagctgcaaaaaattctcgctggcggtaaaggcaaagtttatttcgccgaaaccgagggcgcattgcgttatgtagtggcagataacggcgaaaaggggctgaccttcgctgttgaaccgattaagctgacgctatctgagacacctgaaggcaacaataaatgacaaaaagcaaagcctttgaggggatgaatctctatactgttcacagaccatgctgtcctgaacggcagccatattccttgattcgcttaacgcgtggagaatgaaaatgcgacatcctttagtgatgggtaactggaaactgaacggcaaccgccacatggtaaatgagctgattgctaacctgcgtaccgaactggctggcgtatctggctgtggcgttgctatcgcgccgccggacctgtacctggatctggcgaaacgtgccgcagacggtagccacatcatcctcggcgcgcagaacgtcgacgttaacctgtctggcgcattcaccggtgaaacctccgcagaaatgctgaaagacatcggcgcaaaatacatcatcatcggtcactctgagcgtcgtacttaccacgcggaatccgatgagttcatcgctaaaaaattcgctgtgctgaaagaacagggtctgatcccggtgctgtgcatcggtgaaaccgaagcggaaaacgaagcgggtaaaaccgaagaagtgtgcgcacgtcagatcgacgcggtgctgaaaactcagggcgcggccgcctttgaaggcgcagtgattgcctacgaaccggtctgggctatcggtaccggcaaatccgctacccctgcgcaggcgcaggcagtacacaaattcatccgcgaccacatcgcgaaagtggatgcgaacgtggctgagcaggtcatcatccagtacggcggttctgtaaacgccggtaacgcagctgaactgttcgcccagccggacatcgacggcgcgctggttggcggtgcttccctgaaagctgacgccttcgcggtgatcgtgaaagcggcagaagcggctaaacaagcgtaaaaaacctttgcggcgggtggcgcttcgctaacccgccctgcggttctccaggcccggtaagcgccagcgccaccgggcttttttacagccgtcccagaatactgaaccacagataatccagcggcagcagcaccagataggttgccaccgccagcgccagacagagcagcattcccgcccgcgccggcactttgcccagcgccatcgccaccacgataggcgatgcctgatacggcagcagcggcgtcgaataccccagcacctgaatcatgatcaccgacagcagcggaaagcccgtcgcatcggcgaaactctgcgccagcgtggtgtacaacgccggtacgccgttggcggtcataataaagtttaacgccgtggtgatgccggtcagggcaagaaaactggtgaagggattatcgggatcgagcggcatcacgtgcagcagcgcgccgcctacggcgctgccaatgccggtctgagtcacggtgatcgcaagccctaaaatgcccgccacataaatacaggtgcgcatattcacgccgctggcaaactcgtcgccggtgatgaaacccacgcgcggcaacagggtgacgcatgccgccgccagcccggtccacgccggaccgataccgtgccagctctcgctcacccacatgatcagcaccaccgccagcagccaggcgagtcgtttttcctcccggctcatcggcccggcgggagccagctcgcgcggcgcatgtggtttaccgggaaacagccagcatatcagcccgatcagcaccaggcctttcagaatgccgagcaccggcgtatgcagcagcaggtagggcagatagttaagatgaatgccgtaagagccttccgccgccccgctcatcaccagattcggcacgttagcaggcagaatggtcgccgacagctgaaaagtgccgaagcccaccgccagcgccagcccgtaccaggcgcgcgtgccgtcgttgatcccggcccgcgccgccattgccgcgacaatcggcatcaatagcgctatacgccccatgttcgacggcatgacaaatgccagcgcatagctcagcagtaccacgctgccgaccatcaacggccaggagtcggtgagcctcgccgacagcgccctcgccgcccggtctgccagcccggttttgcggatcgccacgccgagcacaaatccgctgaataccagccagaaggctgaagaagcgaagccgccgaaaatgacgtccggcggggcgatttttgccaccatcgccgccgcaaaaaacaacagcgcggtaataaactccggcagcagtgacgttgcccagagcacgatggtgacgccaacaatcagcgacggaaggaacagcggatgtgaaaaccagagcgacatacctgtctcctgacgatattttcagcaagtctacggcgacaactccgccccgtaaacgctaattattcgcaggttatttgaggatcgcacactcatgatcctggatttcctcggcggaggcgcggttaagcagcagcagattgcggctggtcgccagcagaacaaaggcaccatccgcctgttttaccattgccagcgcatagcggcccatatgctcgcgcgcgtccggcacttcttcggccagcattaaaaacgggctgcgcttcaccagttcgttttcagtgacgcgacgggccagatagtcatgcccgcgcagcccgccggggaacggcagccagcggctgctgatcgcggcgctgtgttcatcaagcgcggcgcggacatcgggccgcaggcaggagatatgaatatggaaatgattttgcgtgcgtccgctgcgggaattaatggtcagcgataccgcctcatcaggcacaggcgcgccccggcgttcgctcataaaacgtcgcgcgctccacgcctgccagaaaaagttcggcgtttgcggctccagcagcagcgggctttccgtgccgttgattttataggttggcatcaacaggtactgcaacgggccattacgatctttgaacaccacgtacccacttttggggttaacctcggcgcagggttgctgatggggaagacactgttcgaaaacaatctgccgcagcgcattcggattaccggactgaagccacagccagacgcccgcaacggcggcgaggagaagaataatcagcaggatgaagatagagagaagtcgtttcattttacgttccggaaaaaacttttaccggaagggtaacgcaaaataatgaccaaataaaaacgctgcccgactcactcgtgtcgccgggcagcagaggataattaacgcttactgatctggtcgaaagtaccgccgttagagaagtgctctttctgggctttcgtccagccgccgaactcttcatcaatggtgaacagtttcagtttcgggaaggcgccttcgtattttttcgccacttccgcgttacgcgggcggtagaagtttttcgccgcgatctcctgaccttccggtgagtagagatacttcagataggcttcggccacggttttggtgtctttcttctcgaccactttgtcgaccacggaaacggtcggctcggccagaatggattcgctcggcgtgacgatctcaaacttgtctttgcccagttcgttggtcgccagcagcgcttcgttttcccaggcaatcagcacatcgccaataccgcgttccacgaaggtattggtcgcgccgcgtgcgccggaatccagcacttcaacgtttttaaacagcgacttcacgaagtcctgcgctttagcctgatcgttgttgttgtgatgcagggcgtagccccaggccgccagatagttccagcgtgcgccgccggagcttttcgggttcggcgtgatcacagagacgcccggtttgatcagatcattccagtcgtggatttgtttcgggttgcctttacgcaccaggaagacgatggtggaggtgtacggcgcggagttatccggcaggcgtttgatccagtttttgtcgatacggccacgttcggcaatcgcatccacgtcataggccagcgccagcgtcaccacatcggcctcaatgccgttgataactgaggttgcctgtttgcccgagccgccgtgcgactggcggatcacgacgttatcgccggtttcctgtttccagtgagcactgaacgctttgttgtactgatcgtacaactcacgcgttggatcgtaagacacgtttaataactgaatatccttcgccagaacactgccggatgccagcagtaaagttaatcccacgccccatttgttcattgctcactctcatatgctgttgtgttgtgatgaaagcagcgtgccagaaagcgaaccaatgattaaagaataaaaaaagattggctataacagtgaggaataagaaaagcatccccctccgggcggagagggatgagaaggcattaatagagttttttggcacagtccagccagtcgcctttgaacggacgcttcatgttctcgatagcgtcgatgatgtcgtggtgcaccattttttcgttctgaataccgacgcaacgaccaccgtggccctgcagcagcaattcaatggcgtaagcgcccatgcgggaagcgagaatacggtcgtaaggcaccggcgaaccgccacgctggatgtggcccagtacggtggcgcgggtttcacgctgcgtttcttcttcgatgtatttcgccagctcgtcgatgtcgcagatgtgctcggtgatggcaacgatggcgtgttttttacctttcgcgataccggctttgatctcgttaaccagatcttcgcggctgaactccacttccggcagtacgataaactcacaaccgcccgcgatagccgcagccagcgtcaggtcgccgcagtaacggcccatcacttcaacaatggagatacgctggtgagaggaagaggtgtcgcgcagacggtcaatggcttcaacaaccgtgtgcagcgcggtgaagtaaccgatggtgtagtcagtacccgccacgtcgttatcgatggtgcctggcagaccgatgcacgggaagcccatttcagtcagacgcttcgcacccatgtatgagccgtcgccgccgatgaccaccagcgcgtcgataccgcgttttttcatgttttcgatagccacagcgcggatatgctcttcgcggaattccgggaagcgtgcggagccaaggaaagtaccgccacggttgatcatgtcggacacgctgtaacggtcgagctgcaccatacgatcttcgtaaagacctaagtaaccgtcataaataccacaaacttccaggccttccgttaatgccgcgcgaaccacgccgcgaattgcagcgttcatgcccggcgcatcaccgccacttgtcaacacaccgattttcttaatcatgactacctctgaactttggaatgcaaaatgaattctgttgcccgaagcgactcccccgaaggagtgaacaacgatgttgcgaatagtatatcaatatctctgtgctgaattgattcaggtcaggcgaaatggcgctaatttctgtacaaaaaagtggcctgactcactcttttacaaccgatcacaaagcattgattgacgtacccttttcctgaggtactaccgaacaaggatcctgatggatgatgacatccgaccccggaaagcgttgcaggatcgcctgctcaacctgttcagccaccagatgcgcctgaacaaggggaagattgtcatccatttccaaatgaatctgtataaagcgggtcggccctgactgccgcgtgcgaaggtcgtgcgcgccgctgactccaggccagcgagtgacgatttcgaatatttcctgacgttcgatgtcaggtaacgcgcgatccaataatgactgaaccgcctcataacccatacgtagcgcgctgtacaatatataaacaccaatacctaatgcaaataacgcatcggcacggtgccagccataccaggacaggccaagggcgatgagaatcgcgccattcatcataacatcagactgataatgaagcatatccgcccttaccgcctggctttgggtttttcttactacccagcgctggaaggttacaaggatgactgtgcttatcagggcaatcacagtgacaaccaccccgatccccggcgcattgagcggttccgggcgcgccagatgttgtatcccggtcaaaaacaggaacagcgccgagccggaaataaacatactttgcgccagcgccgccagcgattccgccttgccgtgaccaaatgtgtgttcgtcatccgcaggctgtaaagagtaacgcaccaccagcaggttggtgagcgaggcggcaatatccaccagagaatccaccagcgccgccagaatgctgaccgacccggtgtaccaccatgcgacgattttgatcagcagtaacgcgcttgcgaggatcgtcgccgcaatcgccgcccggctgaccagccgtccataagattgattcatagagactcctgccagaacacaggaaccagtataacggatgaaaaaagcctcattgtgatgaaaaggcacatcgaagggtgtgaaattgcagatttaaaggatcccggtggcaaattgcgggcaaaaaaaacccccacatcatgtgggggaagacagggatggtgtctatggcaaggaaaacagggtgttactggttactaccggtactgctgctactcgataacttcaacgatgaactttgctgcatttgcgcgacgtcgcgcagttgtttcattcgctgatcgtgtttcttatgtaaaaccgcttgctgctccggcgttagcaggtggtacatctggttgcgaaccctggccatttcgacctggcgaacaacctgttcttgtgccattttttctgcctgagcgcgcacagcgctttcatcaaatttttgtgcggtgacaaggttgtgcattgtctccacgtcgctcacgttgacagggggttggtcgtgccgtgcccgctgcatgagatcgcgtaactgctgtcgctgatgttcggttaaactaataccgtcaaacatgtggctctggctgctacgctgagtaagtccatctgctggatgccagttatcgcctgttacgtctccagttgcctggctgactgcactgaatgccaggcttgaggccatgacggcagcggtaacattgcgcatcacttactcccaaaatcttttgtttcgcgattcaacgagagccagtgtacggttcaggctgaaaactagcgtcagggggtgtaaaacaacgtaaagtcatggattagcgcgccttgatgacgtaatttctgcctcggaggtatttaaacaatgaataaaatcctgttagttgatgatgaccgagagcttacatccctgttaaaggaactgctcgacatggaaggctttgacgtgttggttgcccatgatggggaacaagcgctcgacctccttgacgacagtatcgatttacttttgctcgacgtgatgatgccgaagaaaaacggtattgatacacttaaagagcttcgccagacacaccagacgcccgttattatgttgactgcacgcggcagcgaactggatcgcgtacttggccttgagctgggcgcggacgattatctgcctaaacccttcaacgaccgtgagctggttgcgcgcatccgcgccatcctgcgccgttcacactggagcgagcagcagcaaaacagcgataacggttcccctactttagaagtcgacgccttaagcctcaatccaggccgtcaggaagccagctttgatggacagtcgctggaacttaccggcaccgaattcacgctgctttatctgctggcgcagcatctgggccaggtcgtttcccgtgaacatctgagccaggaagtgctgggtaagcgcttaacgccgttcgatcgcgccatcgatatgcacatttccaacctgcgccgtaaattgccggaacgcaaagacggacatccgtggtttaaaaccctgcgtggtcgcggctatctgatggtttctgcttcatgattggaagtttgactgcgcgcatctttgccattttctggttaacgctggcactggtgctgatgctggtactgatggtgccgaagctggactcccgtcagatgacggagttgctcgacagcgaacagcgccagggcgtgatgatcgaacagcatgtcgaagcggaactggccaatgatccgccgaacgacctgatgtggtggcgcagattattccgcgcgatcgacaaatgggcgccgccgggtcaacgcctgctgctggtgaccagcgaagggcgcgtgattggcgcagaacgcagcgaaatgcagatcattcgtaacttcatcgggcaggcggataactccgaccacccgcagaagaaaaagtacggtcgggtagagctggtagggccattttccatcagggatggggaagataattaccagctctatctcattcgtccggccagcagctcgcagtcagactttattaacctgctttttgaccgcccgttattactgctgattgtcaccatgctggtcagttcgccattgctgttatggctggcgtggagtctcgccaaaccggcgcgtaagctgaaaaatgctgccgatgaagtggcgcagggtaacctgcgtcagcatccggaactggaagcggggccgcaggaattcctcgccgccggggccagctttaaccagatggtgacggccctggaacgcatgatgacctcgcagcaacgcctgctttctgatatttcgcatgaactgcgcaccccgctgacgcgtctgcaactgggcaccgccctgctgcgccgtcgcagtggtgaaagcaaagagctggagcgcatcgaaaccgaagcgcagcggctcgacagcatgatcaacgacctgctggtgatgtcgcgcaatcagcagaaaaacgcgctggtcagcgaaaccatgaaagcgaatcagctgtggagcgaggtgctggacaacgccgcctttgaagccgaacagatgggcaagacgttgacggtgaccttcccgccagggccatggccgctgtacggcaacccgaacgcgctggaaagcgcgctggaaaacatcgtgcgtaatgcgctgcgttattcacacacgcagattgaagtgggatttgcggtggataaagacggcatcaccattcacgtggatgatgacggtccgggcgtcagcccggcagatcgcgagcagatttttcggccgttctaccgcaccgacgaggcccgcgatcgcgagtccggcggcacagggctgggcctggcgattgtggaaaccgccatccagcagcaccgcggctgggtgaaagccgacgacagcccgttaggcggcctgcgcctgaccctctggctgccgttgtatagcaagcgagcctgatgtagcgccctctccttcaccgggagagggcaacgccggttacccgcgcaaccgccgcgaactgtcttcgattttgccgctaatccgccgtttctgcatggttcttgcccagctcaccgacagccctgccgctgacagcaggcgatgatactgctcatcgtcgaacggcgtatgccaggcaatgacacccgcctcatggacgctgatctcgctgcaacgggataccagctccagcggcgcatcgctgaacaccttcccgcccgccacgatacggtacagccagccggtgtgaccgcgatcctgcatcagcgtcgccatattgggaatgccgaagtggaaattgagcttaaagcacggcgagcgcggctgcgtcacctggatcagcgcctcgccccagcggaaaatatcgccgatatacacgttcttctccgtcagcccgacggtcgacagattctcgccaaaggccggggcgacaaagagcgccgcctggtccgggaaatcccgcgcccattgggcgtaatgttcccgcggatagtggcataacgcacggtcggggccgccgtggatctttttctccgcctgctggtcatctttcaggccgcgttccgtaagcgtcagttcgccatccacctgcactttcgcaatggcgctcgggcggctgcccggataatcgcgcaccttgccggaaaatacctccatcggatattgcatatcgtctccctttgtcataattccactgcgcttcaggctggccggaaacgccgccaaatacaatatttttgcggcatcagcgcgcaaaaaaagtacaccactggcgtgaaatgctgcaagccgtgctatcacttagctaacttctgaaacgccatttcacattcaaggagtcaacaacatgtccagtgatgcacgctttacgggcgtctggtgcccgtccattacgccgatggaaaccgacggcaagatagattttaacggcctgcgccagcatctcgcccgcctgaccgacgccagaatcgacgtgattctgctgatgggcagcatcggcgaattcgcttcctttacgctggaagagcggctgtcgctgatccgcgaagcacgggccatgtcgtcgctgccgatggtggcaaacgtctcctccacttgcgtgagcgatatactgcgtatggcgcaggcgtcctttgacgcgggctacgacgcggtgatgatcctgccgccctactactacggacagacatctgcgcagctgctcagctactaccgcgcgctcgggcagcagctgaccggcaaatggttcgcctataactttccggcgcgtaccggctgtgatctgacgccggagcttatcgccacgctggtggcagaattccctgacttcgccgggatcaaagacaccgtggactgccagtcgcacacccgcaatatgatcctcgccacccgggcggtacgggaggattttgccgtactctccggctacgacgagtattttattcccaacaagctggcaggcggcgccggggtgatttccgggctgaataacattgtgccggagctgttcgtccgcgcgcgtgaagccttcgcccggggcgatctgcaaactttacagcaggttcagcaggagattggcaagctgtcggcgatttacgccatcggcgatgattttgtcaccaccattaaaaccgtggtggcgcgcaaatttggttattgcggaacgacatcgcgtaacgcgggcggcacgctgaacgtcgcgcagacgcgtgccatcgacgaggttttcggcctgtagcgggcaaaaaaaagcccccgtcggcttaccgacaggggctggacagattcaccagaaggtgagcaggacttattttttagccgcgaaacgtgccgctgcttcgtcccagttaaccacttcccagaacgccttgatgtaatccgggcgtttgttctgatatttcaggtagtaagcgtgttcccacacgtccagacccaggatcgggaagccggatgcgccagaaattgcttcacccatcagcgggctgtcctggtttgcagtagagactacagccagtttgtcgcctttcagtaccagccacgcccagccggagccgaaacgggtggcagccgctttctcgaactcttctttgaatttctcaacagagccgaaatcacgttcgatagccgctttcaggtcgccctgcagggtggtaccggttttcaggcctttccagaacaggctgtggttagcgtgaccgcccgcgttgttacgcagtacggtttttttgtctgccggcagctgatccagtttggtgatcagctcttcaaccggcaggttagcgaattcaggcagactttccagcgctgcgttagcgttgtttacgtaggtctggtggtgtttggtgtgatggatttccatcgtctgcttatcgaaatgcggttctaaagcgtcgtatgcgtatggcagggatggcagtgtataactcatattcatctccattattgtcgggcggctgaagtgttaacgccgcgtaagcagttggttcattatagttaattaactggtattgaaaatgtttatcaatgccgtagtttctgtgtggttataacttttcgttatgacactgtcaattttggcgctaagcgttgccgccactggcttggcgtcgcgcccgtttcacgggtaaacaccaccgagaaatagttgctgtcttcgaagccgcagcacatggcgatttcgccgattaacagttccgtatgttgcagcaaatactgcgcgtggcagatgcgcagctggcgcagatagttgttgatggtcatgccggtctgggtgcggaattgctgccgcagcgcgcgttcgctgcactggttttgctcgcagaacgtctccagcgcaaaggcccggttcaggctgcctgccagcgccgtgatgagcctgtcgagcagcgcctcgctggcggtagccgacaggttatccgtggcgtagcgatgccgtttaagcgtcaggatcagctgcgcgaacagcgcctccgccagcgggttcgccagctcgtccgttctggcgctctcctgctccagctgggtgatcacctgccgcgcctgcgtcatgccggtgctgccaagccgccagtagggcgactgctcacggccctgtagccccggaatatgcgccgcccagtccagcgccagcgtcaggcgctccgggcagtagataatattttgcagcaccaggtcgttcaccgaggcgtaagagtggcgatcttcggcgcggatatagaacagatcgccgcgggtgatgcggtaaggccggtcgttcagaatgtgcagcccgttgccgcgccacaccagcaccagttcattaaactcgtgggaatgctccgcaaagacgttttgcgggtagcgatccgccaccgccaccgcctgtccggtacgggcaaaaaaatcggctttgcgaagaattaactggcctgccacaaggtcacctcaacagcgattaacctttcattattagctgttttctggcgaaaatacggtgataaatctctcgttacgcgcagctactgtaaaagcgtgtcgcgcccctggcggatatcgcgcggcgaccagtcgaactcccggcgaaaaagcgttgaaaagtggttactgtcgccgaaaccgcagcgaaaagcgatgtcagtgacgctatggtcgctgtggcgcaataaatgtcgcgctttgatcagccgcaggcgattcagatagcgctgcggcgtcataccggtgtactgcttgagctgacggtgcagggtgcgcagcgacagcgagaactgatccgccagcgactcccagcacacctcttccgcaaaatgatcttccagccacgacatcaactgattcaggcgcgcatcgttattcgccgccccttccatctggctgctgcgacgcaacagcaccagcaactgcataaagaggatctcacggttcgccagcgccgccgtatccttgccctcatccgccgtttccatctgcccgacaatctggcggatctgttgcaatacgccctgattcacgcgccagtgagacggatagtgcccgtcctgctcctgcggcagtaactggtttaagccggataagaactggaacgcgtccggggagcggtacagcacattggtcaggcacagattatcggtgtgctcatagagatgccggtcatgatcgcgtacaaagcacacggtgccgccgctgatggtgtagggctgaccattgaagacgtgaataccggtgccgtgctcgacgatcacaatctcatgaaaatcatgatgatgttccgggaatgccgcctggggcagccggggttcaatagcaacaggcgtataacctgatggaaaaaagtccacgctgtgtaatacggtcatagcaacccctgtcgatgagaaacgttctcaatatagtaattaacgccctctgttctcaccttgaatttttgacagcaaagcgcgcaaagcctgtcgatttttcaagaaactgtcggaaagttcaggaaatgcggcggcggtcacagcggctgaaaaaccgctgataagtggaaattgtgaactctctcacgttcatctttggtttcttgccagcggcggtttgggcctgtcactggcaagaaggtgatcctgctggcccttttttagactggcggcaatgactcaccagaggatcgctccatgacttttcgccattgcgtcgcagtcgatttaggcgcatcaagcgggcgcgtaatgctcgcccgcttcgacgttgagccgcgtacccttacgcttcgcgaaattcatcgcttcagtaactgtctgcaaaaaattgacggcaccgagtgctgggatatcgacagcctggaagcggaaatccgctgcgggctggataaagtccgtcagcagggcatcgccatcgacagcatcggcatagatacctggggcgtggattacgtgctgattgatgcgcagggcgagcgtgtcggtctgccggtttcctaccgcgacagccgcaccgatggcgtaatggcgcgggcgttagcgcagcccggtaaaaccgatatttatcgtcgcagcggcattcagtttttacccttcaacacgctctatcagtttaaagcgttaagcgaacagcagccggaactgatggcgcgcgtcgcccatgcgctgctcatccccgactatttcagcttccggctgaccggccagctcaactgggaatacaccaacgccaccaccacgcagctggtaaacattcacaccgacagctgggacgagacgctgctcgactgggcgggcgtacccgccgcctggcttggcacccccacccatcccggcaatgtgatcggtcactgggctgacgtgccggtggttgccgtcgccagccatgacaccgccagcgcggtgatcgccgcgccgctggccggcaaagacgccgcgtatttatcctccggcacctggtcgctgatgggctttgaaagcaaaacgccctacaccagcgatgaggcgcttgccgctaacatcaccaacgaagggggcgcggaaggccgctatcgtgtgctgaaaaacatcatgggcctgtggctgctgcaacgggtgctgaaagagcagaacgtgcaggatttggcggatctgatcgcccgcaccgccgccctgcccgcctgccgtttcgtcatcaacccgaacgacgcgcgctttattaatccggaaaacatgagccgcgaattgcaggccgcctgccgggaaaacggccagcccgtaccgcacaccgccgctgaactggcgcgctgcatttttgacagcctggcgctgctgtatgccgatgtgctgcacgaactggcgcagcttcgcggtaaagccttcagccagctgcatatcgtgggcggcggctgccagaaccagttgctcaaccagctgtgcgccgatgcctgcggcatcaccgtggtggctggccccgttgaggcctcaacgctcggcaacatcggcgtgcagttaatgacgctggacgagctgaacaatgtcgacgctttccgtgaggtggtggcgtccagttacgccctcaccacttacacccctcatcctgataatgaaattgctcgctatgttgcgcagtttcagcaaaaacgaccaacaaaggagctttgcgcatgaccactcaacttgaacaggcctgggaactggcaaaacagcgcttcgccgcggtgggcattgatgtcgaggcggcgctgagccagctcgatcgcctgccggtgtccatgcactgctggcagggcgatgacgtcgccgggtttgaaaacccgctgggcggcctgacgggcggcattcaggcgaccggtaactatccgggcaaggcgcgcaacgcaacagagttacgggccgatctggagcaggcgctgagcctcattccagggccgaagcgcctgaacctgcacgccatttatctggaatccgacgagccggtagcgcgcgatgccatcaaacctgaacactttaaaaactgggtgagctgggcgaaagagaaccagctgggcctggatttcaacccgtcgtgtttctcgcatccgctttccgccgatggctttaccctgtcccacgctaacgatgagatccgccagttctggatcgaccacgtgaaagcttgccgtcgcgtgtcggcgtatttcggcgagcaactgggcacgccgtcggtgatgaacatctggatcccggacggcatgaaagatgtcaccgttgaccgcctcgcgccgcgtgagcgtctggtcgccgcgctggacgaggcgctgagcgagaagctgagcctggcgcatcacattgatgcagtggagagcaagctgttcggcatcggtgccgagagctacaccgtcggctctaacgagttttacatgggttatgccaccagccgccagacggcgctgtgcctggacgccggtcacttccacccgaccgaagtgatctccgacaaaatctccgctgccatgctctacgtgccgcgcctgttgctgcacgtcagccgcccggtgcgctgggacagcgaccacgtggtgctgctggacgacgaaacccaggccatcgccagcgagatcgtccgtcataacctgtttgaccgcgtacatattggcctcgatttcttcgatgcctccatcaaccgtatcgccgcctgggtgatcggcacccgcaacatgaaaaaagccctgctgcgcgccctgctggagccgaccgacgaactgcgtcgcctggaagcgagcggtgattacaccgcgcgtctggcgctgctggaagagcagaaatcgctgccgtggcaggcggtatgggaaatgtattgtcagcgcaacgacacgccggtcggcagccagtggctcgacagcgtgcgggcgtatgagaaaaccgtgttggccgaacgccagtaaatacaccgcccggcggcgcttcgcttgccgggcctacgcatgacatgtaggccgggtaagcgtagcgccacccggcattgagataaatgtaggccgggtaagcgcagcgccacccggcgttttcaaaggaaccacaagactatgcagaacatcactaacgcctggtttgtccaggggatgatcaaagccacctccgacgcctggctgaaaggctgggacgagcgtaacggcggcaacctgacgctgcgcctggatgaggcagacatcacctctttcgccgcagatttccataaagagccgcgctacatcgccctgagccaaccgatgccgctgctggctaacacgccctttatcgtcaccggctccggtaaattcttccgtaacgtgcagctcgatcccaccgccaacctcggcatcgtcaaggtggacagcgacggcgcgggctaccacattctctgggggctgaccgacgatgccgtaccgacatcagagctgcccgcgcatttccgctcacactgtgaacgcatcaaagcgacccatggccgcgatcgcgtgatcatgcactgccacgccaccaacctcatcgccctgacctacgtgctggaaaacgactctgaccttatcacccgcaaactgtgggaaggcagcaccgaatgcctggtggtgttcccggacggcgtcggcattctgccgtggatggtgcccggcaccgatgaaatcggtcaggccaccgccgatgcaatggcgaaacattcgctggtgctgtggccgttccacggcgtctttggtagtggcccgacgctggatgaagcctttggcctgattgacaccgccgaaaaatccgctgaagtgctggtgaaggtgtactcgatgggcggcatgaaacagaccatcacccgggaggaattaatcgccctcggcaaacgctttggcgtgacgccggtgcagtccgctttagatttgtacaaataacaacatcgcgccccgctcacgaagacggggcgaataccacctgccatccctacaaaaactaactcgtggagtacaagcaatgaaaattaaagcaagcttaatcctcaccgttgctgcgctggcgttgtccggttccgcattagcagaagtcaaaatcgccctggtggcaaaatcattaggtaatggtttttttgaagcagcgaacgtcggcgcgcaggaagccgccaaagagttaggtgatgtaaaagtcatttataccggccccaccaccactaccgccgaagcgcagatcgaagtgctgaacggcttgatcgcccagggggtggatgcgatcgccatctccgccaacgatccggacgccgtggtgccggtgctgaaaaaagcgatgcagcgtggtatcaaagtcgtctcctgggactccggcgtggcgaaagccggccgccagatccatctgaatccctcgaacaatgcgctgatcggcgaaaccaacgtcaagctcgccgccgaagcgctgaaggcgctgaacgtcgaaaaaggcgatgtggcgatcttaagcgccacgccgacctctgcgaaccagaacacctggattgcggaaatgaaaaaggtgctgccgaagtatccgtccgtcaatctggtgaccaccgcctatggcgacgatctgtctgacaagagctatcgcgaagcggtgggcctgctgaaaacatatccggatctgaaagtgatcgtttcgccgtcgtcggtcggcatagtagcagccgcgcaggcggtgaaggatcagggcaaaattggcaaagtgtacgtgaccggtctcggcctgccgtctgaaatggcgggggcggtgaaatccggcgcgaccaaaagtttcgccatctggaacccgatcgatctgggctatgccgccacttacctggcggatgacttagtgaaaggcagcgccaccaaaaccgaggccagcatgggcaaactcggcaaagtgaaactggatgcggacggcagcggcgcgatggctgagccgttcgtctacgatgccagcaatattgataagttctccaaaattttctgatccgttttctgacatacggcgggtggcgctgcgcttacccgccctacaagaaatctcgttatgcggagaactatcatgacggcatccacccctctgctgtcgctcaagggcatcaccaaggttttccctggcgtgcgtgctcttgagaacgtgcagctcgatctctggcccggcaaagtcaccgcccttatcggtgaaaacggcgcgggcaaatcaacgctggtcaaagtgatgaccggcatctatcagccggaagaaggcgaaatcctctataaagccattcccattaacctgccggggccggaagcggcgcacaaagtcggcattaccgccatccatcaggaaaccgtgctgttcgatgaactgtcggtgacggagaacatttttgtcggacagtatctgtataaaggctttctgaagaagctggactggcccgccatgcaccagaaagcgcaggccattctgacccgtctggaagtgcagatcgatccgcacgcgacgctgaaaaccctgagtatcgcccagcgccatatggttgccatcgcccgggcactctcctttgacgcccaggtggtgatcctcgacgaacccaccgcggccctgtcgcagcacgaaattctggagttttaccagatcgttgagcgcctgaagcaggaaggcaaagcgatcatgtttatctcgcacaagttcgatgaaatcttcgagctggcggatcactacaccattttgcgcgacggggtgtacgtcggctccggcgcgatgagcgacatcactgaagagcgcatggtggcgatgatggtgggccgcgccatcacccagacctacccgaaaatagcctgcgagccgggcgatacggtgctggaagtgaaagatctctgccatcccacggaattcgcgcacatcaatttctccctgcgcaaaggggaaattcttggcttttacgggctggtgggggcggggcgtactgaactgatgcaggcgctgtccggcgtctcgcggccgtcgtccggcgagattgtgctgaacggaaaaagggtagagttccaccagcccgccgatgccattaacgccggtatcgtctgcgtgccggaagagcgccagaaacagggggcgatcatcgagctgcccatcgcccagaacatcagcctgccgcagctcggcaagcttaaccccaacggcgtactgaacgacgccagggagtgggcgctggcggatgagtacgcccgacgcctgcaagtgaaggccttcagctggaaacagccggtggaaaccctctccggcggcaatcagcagaaagtggtgattggcaaatggctcgccacccatccggacgtgatcatcctcgacgaacccaccaaaggcattgatatcggctcgaaagccgccgtacaccagtttatgtccgaactggtcgggcaagggctggcagtgatcatggtgtcgtctgaactgccggaagtgatgggcatggccgaccgcatcatcgtcatgcatgaggggctgatggtcgcggaataccgcgcgggcgaagccacggcggaaaccattgtcagcgccgccagcggcgcggcgcaggaggcggcataatgtggcaacaactgcttaaaaatcgcgaagccttgctggcgtcggtgattgtgctgatggtgatcgccattggcagccgcgcgccgtcgttcgtcgccccgggtaacctggtcgagatctttaacgacacctctattttaatcatcctcgcgctcggccagatgatggtgctgctcaccaaaggcattgatttgtcgatggcagctaacctggcgctgaccggcatgatcgtcgccctgctcaatttccactatccggcgatccccgtctgggcgttactgctgctggccaccgcgctcgggctggtgatgggcatcatcaacggcctgctggtgtggaaaatgggcatcccggcgattgtggtgaccctgggcaccatgagcatctaccgcggcattatttttctgctctccgacggcggctggatcaactctcaccagatgagcagtgattttctcggcctgccgcgcgctgccgtgctggggctgccgctgctgagctggtgcgccatcgccgcgctgttgctggtgggctacttcctgcgctacagccgcaccggacgcgcgctctacaccgcaggcggcaacgccaccgccgcgtattacaccggcatcaacgccggaaaaatgcagttcgtcagcttctgcttatccggagcgctggccggtttctgcggttacctgtggatctcccgcttcgccgtggcctatgtggatgtggcgaacggctttgaactccaggtggtcgccgcctgcgtcattggcggcgtcagcaccatgggcggtaccgggcgcgtgctcggctgtctgttcggcgcgctgtttctgggcgtcatcaataatgcgctgccggtgatcggcatttcgcccttctggcagatggcgatttccgggacggtgatcgtcattgcggtgctgctgaacgagcgcggcaataaacgtaaagggcggctgatcctgcgcgatgccgcgctggcgcgtcagaaaatggcggtgaaatcatgagcaaaattatgaccactgaagagatgaacacctcacccgccgccacgccatggctgaaacgcctgctgtgctgggagggctttttactggcggtgacggcggcggtgtttatcgccaatgcgctcgcgtcgccctatttcctcgacatctggaacctgtcggacgccaccttcaacttcacggaaaaagcgatcatcgtgctgccgatggcgatgctgatcatcgcccgtgaaattgacctgtccgtcgcctcgaccatcgccctcagttccacggtgatggggttctgcgcccaggcgggcgtcgatacgccgctgctggtctgcgtcgggctgggcgtcggcctgctgtgcgggctgttcaacggcgtgctggtgacgcgctttaatttgtcctccatcgtcatcaccatcggcaccatgagcctctaccgcggcattacctacattctgctcggcgatcaggcgctgaatgcgtatccggaaagctttgcctggtttggtcagggctacgtgtggggggcgttgtcctttgagtttgccctgttcatcgtgctggcgggcgtgtttgcctttgtgctgcaccgtaccaactttggccgccgcacttatgccatcggcaataacccgaccggcgcgtggtattccggcatcaatgtgaagcgtcacaacctggtgctgtttgcgctggtgggcctgatggcggggctggcctcggtgctgctcacctcgcgcctcggcagtacgcgcccgaccattgctaccggctgggagctggcggtggtgaccatggcggtgctgggcggcatcaatattctcggcggctccggcagcatggtcggcgtgatcatcgccgccttcctgatgggattagtcacctttggcctcagcctgcttaacgtgccgggcatcgtggtgtcgatcatcataggcgcgatgctgattgtggtgatttccctgccgattattacgcgacggattatgcagcgaagacgaatttaacggccgggtggcactgcgtttacccggcctacgatgtaggccagtacaagcgccgcgccgccgggcataaaaaatcacagcaagataaggagatttatcatgagctttatgttggcacttcccaaaatcagcctgcatggcgcgggggcaatcggcgacatggttaacctggtcgcgggcaaaaagtggggcaaggcgctgatcgtcaccgacgggcaactggtgaagctgggcctgctggatagtctgttcagcgcgctggatgcgcaccagatgtcttatcatctttttgacgcggtcttcccgaacccgaccgaagcgctggtgcagaaaggttacgccgtgtatcaggatgccgaatgcgattacctgatcgccttcggcggcggtagcccgatcgataccgcgaaagcgataaaaatccttaccgccaatcctggcccgtccaccgcctattccggcgtgggcaaagtggtgaacgccggggtgccgctggtcgccataaataccaccgcgggcaccgccgctgagatgaccagcaacgcggtgattatcgacgccgaacgtcaggtcaaagaggtgattattgatgccaacattattcccgatattgccgttgatgatgccagcgtgatgctggaaatcccggcctccgtcaccgcagcgaccggcatggatgcgctgacccacgcggtggaagcctatgtgtcccttggcgcgcacccgctcaccgatgccaacgcgctggaggctatccgcctcatcgcccaatggctgccgaaagcggtggatgacggtcataacctggaggcccgcgaacagatggccttcggtcagtacctggcgggcatggcctttaacagcgccggtctgggactggtgcacgcgctggcccatcagccgggtgccacacataacctgccgcacggcgtctgtaatgccattctgctgccgatcattgaaaactttaaccgccccaacgccgtggcgcgttttgcccgcgtggcgcaggcaatgggcgtcgatacgcgcggcatgagcgttgaagccgccagcgaagaagccattatcgccattcgcgcgctgagcgcccgcgtcggcattccgtccggcttcagccagttgggcgtcaccaaagacgacattgaaggctggctggataaagccctcgccgatccctgcgccccgtgcaacccgcgcgccgccagccgcgaagaagtgcgcgagctgtatctggaggcgttatgatccgcaaagcctttgtgatgcaggttaatcctgatgcccacgacgagtacgaacgccgccataatcccatctggccggagctggaatcggtgctgaaagatcatggcgcgcaccattacgcgatctatctcgataaagcccgcaacctgctgttcgccaccgtcgagatcgaatccgaagagcgctggaatgccgtcgccagcacggacgtatgccagcgctggtgggaatatatgtccgccgttatgccgtcaaacccggaccacagcccggtcagtagcgagctgaaagaggtgttttatctggagtgatagataacgcccggcagcgcttgccgggcgtgttaataaatctgtcagacagtgtttaaaggcgttttgataattcccttctcgccagctcagcgataaaaccgctacggctggtgtagtctttattatttacgacataagcatctattcttcttaacaaattttgcggcaaagtaatatttaatttcaccgatttgccatcgtatttagaggtatcaatatccacgatcccccacatgccgccctggcagtcttcatcatctttatgatcgttcatcgtacgtgctacaggtacgtcttttcctttctcactccggtagtccagatacgcatcaatagctgcatgagcatcagcgatcgcatcatcaatggtatcacctgcgaaatagcatccagccagatcgggcacaaaaccagaaaaagcgccgctttcggtctgatgtaaataaactggatatttcatggtttttcctcattcagaagtgacgtgcgccaacacgcctttggcacttatttttcgcctaattgcttcaaaatcttatgtaacgtaccggcagctaaatccttatttggatggggaaccactatcggctcaggctcaccttccttttcaaaaatgtgatgcgaacctctggtgcggacatgctcccaacctgcctttttcagcttcttcatgacttcagcgctcgtcatacattcctcaacgtccctgtaagctttagtggttattatacccaccacttttaaaatcggtcaattaaatggtgggtatggtggttactgaatgtgaggttctgtgcgaaaatttattccactacccatctcccccgtctccacattaatatgaaaatgacatgccgggctgccgtgcaggtatttatcgatcaccgcaaaaaggctgccgaaacgtagccggaaaatatcttcaaccgcgctgtgttgattgacctttagggcgacaggagataaacgggtcgccagcgcgcccgttagcagctggtactggtgcaaacggtcggtgggaatatcctgtaaggccagctcatccgcattgcgtaaacggtagaaatccaccgccagatcgaaaccgttccagcgggcaaaatcctgccgtttcatgcctgctttttgtgccagcgcctgcgctttttgccgtgccttttcccaggccgcgccgctttttttaccatcgtattcgccttgattgagctggcttgcgatcagcatctcctcgccgtttagcgaaaacagcagctggcgcagatcctccggccactcttccggcagaaaacgcaggcgggtgagttcagtgatatgccagttagtgaaggcgtagtagctgtcggcctgcaaaatggcgcggttccacagatggggcgagtgcacggcgttaagatgatcccactcctgctgatagtgctcaaacagttcatcaaaacgcggaacgtccttaaggatcaccgtctgcacgtcgatctccagcgggctggtaaagttaaggattttataggccggaacgtaggccgccagcgacggcgcctgaatgttgaacaacaggctgccatcggcataacggcgcacgccggtatcgttaaaatgcatatgaccgccaacgtgcacgccaatgccggtttttgccagcgcgtggctggtgtcctcgcgcggcgcgcgggccagctggaattttccctcgccaaaaatatcagcaagatccgcagccgcgccgttatcgaattccaccatcggaaaatggctgaaggtgaccagcgttttgttgagcgctctggcacgctgcgcaacatccgccatccaggcgacggtctgctgtttgtgcgtcagcatgctgttgtagcccgcctcgccggaacccaaaaactgcggtttatccgcgcgggcgtcggcggcgggcagatagacgttggcgtccaccgccagcaaccacaaacccggcaccggctccaccagataactgctgtcggcgacggtaaagcaggggccgtaaccgggctttttgtagatcccacccgttccctgggcgcagatttcatactgccgctggctgaaatcgctggcccgctgcgccgcctggtagctgtaattttccacgccgtaaccggagtacggcgtttcccagtacagatcctctggcgatggattgatgccgaacggccccatcgccgtcatgatcgcctgataaccgctgtggaccatctcctcgctgcaaatcgtcggcagtccggcgtcggttttgatccgcgctgtcgcgccctggtaaccctgacactcttttgcgccacggctgaagatacgctgggttttgccgccctcccccagaaaatcctcctcaccgcctggcgtggtaaaggggcggttcggatcgtggttgccgggggtggcgaaaaagcgcatgccatacttttgctcgtattcatgcagcagttttaccagcccgcgcacatggtaaggctggccgtcatcgctgaaatcccccggcagcgccacccatttgatgccctgctttccggcatcgtccagcgcggcgcgcagcgcaaaatagttctcattgaacagccgggtggaggtgagttgcgcatacatggaacgaataatagcgggcttgccgcttttgctgttcggcaggccggtaaaggcctggtccgcaaactcgccgtacacgtcgtgaaagtgaatatcgggcataaaggcgacgcggtactgatatttctctgccgctggtgatgcgccgctggcaatcagcagcaggggtacggccatcctgattagccttttcatttgtcctcccgataaaaatcaagacgccagctgacaggcgtgccgggcggtacgctgccatcgccgggctgcgccggggtttctgcgagggtgattttttgccagtcgcctgccgcgtcaggcgcgctatccggcagcggccgcaggcccggattccagccgcgtaacaccagcgcctcgccgcgctgcgcttttttcagcgtgctgaagtgcagagcgctgccccaggtaagcaggctgtaatgggcgggaaagcggatgccgtggggattggtgcgaaaacgtgaccagcccgaatccagatagccgctggccggggtgcgccagtgctccaccgtgcgccagaattcgtcactctgcccctgcgccatcggcagcacggcaaaattaaagcgcagcattccctgaatttgtgagtccggcgacggcagcaccatgcccgacgcgcgccctggccgccaggggagatccggcaggccaagccagccgacgctgcgaaacagcgtgagggcgataacgccggtctgctccgccgggagttcatattcccgtagccctgccgtcaccaccgccagcccgcgggtttcatggtgcagcatcaccaggctttgcactggccacagcgacgcgggcgcttcggtccagttttccgcctgccagcgttgcagcgcggcgggccggttttcccgttcgatcaggccaaagggctgatcggcaaaatgaaatgcctgtgcaatgcccaccgggatttccacctgtaagcggtgatcgcgcagggtgttgttaacctcaacgttgacgtcaagccagggggcgtcatggggcagcgagaccgtcatcgtcaccgccagcgtggcgttgcactgctgcgccgcgcgtgatgcggcatcggcaggcgccgggatctgccagcgcagcgtcagggtatcgttcagcgccccgcgctcgccgtgcgcctcctgcaaacagccgtcgctggtgacgcgccagtcctgcgagggcggcgaatagttgtagttatcccccgcgtcgccgccgtccaccagccgcagcacctgcgggtaacgctgttggctgcgtttatcgataagcgtcagctggtcaccgtcgatctccagccgcagccaggggttttccagcgcgctgatggtttcaccagcgtgatcaaagcccgcgggctgcccctcctgtaaatagagcgtgcgatagccgcaggcgggtaacgcctgtgccgccagcacaatctcgcatttacgataccaggtggtggaggtgctgttcgccagttcctgcacgatgatcgacatgtcctgtggggtgtcccgcagcagttgccagcggcagacggtgccgtcttcttccacgatgcgaaaatccgcatgaggggtgtacaaggtcagcgtgacctgcgcatcccggacgtggggcagcggattaaagaggatgatttttttgccatcctgccgggcagtgatcccttcggcgagcattttcatattcagatcaaacagctgctgcgcgctttccagcccgtccgttaaccgcgctttcaccatgctgttgacgcgatcggcattacagccgccgatgctgtcatgggcatgggatttcatcgcctcgcgccagatcgtctccagcgcctgctgtggatacggcagcccaagctgtctggtcaccgccagcagcggctccagcgtctggctgacgaactgctccagccgggcgttgagcaacttgatgtccatgcgcgtggaaaaaataccacgatggatacgcatatatttcgggctgagcagttcgccccggaattcgggcagcggtttttcaccgtcacgcagcgcggcaaaaaaatcgctgaagctgctgcgaataaagcggtactcctgctggcagtcgttgagccgatccagcatcgccgggacggcgtattcaaaaggcgactgatcgttaccgttcggcagcaacagcgcgtcggtgagcgaaaaacgcgcctgtttttcgaggatggcgggcagcacgcgtccggcctgttctacgtcgtccggcagccatttggcgcagccgtaaccccacggcagcaccgccgtggtgacgcgactgccgccctgcgccacccaactgaattcgctgctggcgacatcgtgctcgcaccagccgcgccagatcaccgccgcgtcgatggcgaattcccgcagaaacagcggcaactgcgcgctctggccgaaagagtccggcacgtagcccaccggcatagcactgcaaccccacgcttcgcagtcggcgttgcccagcagcagattacgcgtgatggactccgcgcccaccaccagaaaatccgtctgcgtgtaccacgggccgatgagaatacgtccctggcggatcagcgcctgtagccggtcgcgctgttcgggggcgacgcgcagatagtcctccagcaccaccgtttgcccgtccagcacaaaggggccgagggtggtgtcctgctccaggcggttcagcaaatcatgcataaagtaatagagcaccatgcgcgagtcgttctcggtgaaataccattcgcgatcccagtgggtgtgctgaattaaatgtacggtcttcatcaggcgtaccttctccttatagatgggacggcctcagcgaccggctttaaatttcggcgcggcggcgacgggtttattttccggttcgttttcactgcgaaagaccagcaacgagccgacggcgataatggccgagccggtggcaatcgacagcacgtataccggccagtgactcaccgccagccagccataaaagccggagatcggcgcatggttgaccgcccccagcccgacggccatcgccgcgctggtggcggagccgagcacgttaatgatgatgattttgggattggcgagcgcaaaggggatcgcgccttcggaaacgccgatcagccccatcagcgttgaagcttttccggcctcgcgcagggacgccgggaagcgcttcgcccacagcagcgtggcgacgccaaggccaatgggcggtacgataatcgccacctgggctgcggtattgggatcgtaaatgcccgaggccagcagcgccatcgccgtggttaccgccgctttgttgaccggcccaccgagatcgaagccgaccatgccgcccaccaccgccgcgaggataattttgttcgcgccggacatcgccagcagccagttttccatgccgtgattaagcgccgccagcggcgtgccgatgataaacgccatcactaaacaggtgagcagcgtgccgcccaccggcaggataaatatcggcccggcggacgctaaagctttgggtaaacgcacccaggtggtcagggcgcgcacgatgtagcctgcgacaaaacccgccgccagcgcccccagaaagccggtgcccagattactggcgagcaggccgccgaccatgccgggagccagccccggcttattggcaatcgcaaaactgatgtagcccgccaccaccggcagcatcagcgataacgccatgccgccaaagccgtcaaacttatgcagcagttgcaccaccacgcttgccgcctcgccatggctggcatcccagatattatcaatgccgtacatagacgcgccgatacgtgcgatgcccatgatcaccgctccggcgatgacaaacggcagcatccaggagacgccggtcataatggcgtttttgatttccgtgcccgccgacgggccgcttcctccgttgaacttagccattggcgtgctcctgctccagcgcttcaaataccgcatcgccaaacttgatcggatcggagacgctgcactccagcttgatcatgccgtcgaagcgttctttgccgctgatggcgacatcggcggcgatgatcacgccatccgcccgcgccaggtcgtctgcggtgatgtcattttcaattcccaggctgccctgggtttcgactttgatttcatggccgcgctgacgcccggtaagctccagcgcttctgctgccatataggtatgagcgatgcctgtcggacaggcggcgacgcaaacaataaacatagaaactccttacagggtcggattcaggcaataaaaaaagcacaatggcgaaggcgcgcattgtgctttgcggggaaaccattaaccggaacgcggcgtcgtctgacgcgccgctggcgtgatgacaggccatcagctggcgcaggctggaaatacggaacaggaaggccagctcgtcgcgtttacggctgtgcagacgggtggcgtatccggcgtgatataaaacttttattaacggcgcggcgggacgataaagtgacgggcagagttttccggcgctggaccataattgcgcccagccgacggcggtattttcatccagcgcgtcatgaataatcgcatcgtctttttcaagggaaggaacagaagtaaaccagcaaattttactcagccacgcacgaacagcgctatcgcaaaatagccctgttaacatgcattgaaatagccgctgaatattaatcactgacatctgcctccgttaaaatatcagcggagtataggtcagcgaattaaacgcgaatgtgattcttcacacagtccacggcgttaaattccgtttttaacgccgtgcattcgctcatcgctcagcgacgctgcccgccatgcggccaaacatcggtttgccggtcagcgtaaaggcggagaggagcgtcaccaccagcacgatgctgccgaggatcagataggtgtcctggaagccaatacggtcatacatatttcccgcaaaagccgacaggaaaatcgccgccatctgtttggcaaagttaaagccaatcagatagatggtggcggacaggcgagtgtcgaacacgccggtgatgtatttaaatgcgccaaccaacaggaacggcacttccagcgcgtgcagcattttcagcgccaccacttccaccacggtggtggcgaaggccgagccgataatacgcgtggtcatgatcgccccggcaatcagcagggtatttttcgcgccgatgcggttaatgatccacggcgagcagaacatgatgatggcgttgcacatttccccggcggtggtcgcaaaaccgaaggcctgggtgcccgcctgcggcgtggcgaagaaagacttaaagaaggtggcaaactgctggtcgaacacgtcatacacgcaggcgacgccaatcacatagaggataaacatccacattttgcgctggcggaacaggctgaagaccattttcgcgctgatttgcggctggttggcccccagcgcattcatcacctgcgcggtctggttttgctgcggtcgggcgataagcagtaacagcatcagcatcagggccgccgccgaacccatccagaatacccattccggattgacgctgaacagcatccccgccgtcgaggcgcacaggccccagccgagacagccgaacattcgcgctttgccatactcaaaatggctgttacggctgacgcgctccacataggcttcgatcgccccggaccctgccgagaagacaaagccgatgtagatcccgccgctcagcgcccccagccagatattggttttcagcagcggcgcgaagacgtagaggaaaaagggggcgaataaaaacagcagtaccgagatcacccacagcaagtttttcttcaggccgagcttatcggagatcacccccagcaccggctgaaaagcgatggcaaacagcgagacgcaggagaagacgatgccggtttctgttttggtcaggccgataatgtcggacaaccagatgggcaaaaacggaaagcaggtcgccataatgaaaaagtagaggaagacgaacaggccaaaaatccagaaattagggttgtttttatgggtacagtcggtggtcttcatgttaatccctcagctacgggccgcgtggcggccctgcatgatcatacgcgttcgaaaccaatcagaatggcgctttccggatccagcaccggtaaggccagccccgccaccttcagccattcgccgctgacggtttgctctgttgtcatccacgccgggagtttgcgcatggtatggccgcccgccccggtcagctgaatattgggatcgtccagcagcctgatgcgataacgcgcgccgctatccagacccggcacccgcaacggcatcatcaggctgtaatccggcatcgccagctggctgaccaggaacagcccttgctgctgatcctgactgaccacgcccaccacctgagtcgtggcatccggcatatccacccgccactggttgccggaatgaatgagcccccgccactgcttatagagcgcggcgtaatggcgatagcctgcgcgttcctcttcaccggcgctcaccggatccagctccagccccatgtgcccgaacagcgccgtcagaccgcgaaaagcaatgctgtgctggcggaaggtagcatgacagtgacgattgccgatgtgcgcacccatcacttccggcgggaagaagtagctcatgccgcgctgaatagtattacgctccagcgcatcgttgttgtcggagggccagaaacggtggcagcgggtcagcacttcataatcaatacgcccaccaccggaggcgcaggactcaaattccacgtgcgggaagcgactgcgcagggcatcgaacagtcgataatactggcgggtttgcgcatcggcggcggctttgccctgatgcgcaggctgcaccagctcgcggttcatgtcccacttcacatagtcgatatcatgctcgcccagcagccagctcatgcgttccagcaggtaatcaaaagcttccgcaatgttcagattcagcaccagctgatggcggccagtggcctgcgggtagccaggcattgccagtacccactccggatgggcacgatagagatcggcattggggttgatcatttccggctcgatccagatgccgaactccatgccgagatttttgacatggtcgataaccggcttcagaccatcggggtatttttgctcgtcgagataccagtcccccagcgccgcgcggtcgtcattgcggcctttgaaccagccatcatcaataataaaccgctcaacgccaagcgccgccgcttcgtccgccatctgcatgatataggccggggagtggttgaaatagatgccttcccaggtgttgaggtgcaccggacgcggcttctcctgcggaaagcggatcagctccccgcgcaggaaatgatgatattgctggctcataccattcagcccggccgctgaatagctggcgtacaaccacggcgtccacagggtatcgccttcggcgagcgccatttctcccggcagatagagcgcctccgcctgcaaatagcgacggccgtcagttttcacttcgcagcgcatacggtggttgccgctccagccgagatgcgcgccccacacctcgccctgcatttcgctgaaggcctggctgccggcaatcagcgccgggaaatgttcgtgagaactgcgcccgcggcggctttccagcacaaagctgtcgtgcgtcagcgtgacgcggtgcggctgaaattcgcggatccagcggccatggaacgccatcacctcctgcgcatgcccggctaccggcaatgtcaccgccaggcgatccacctgccagtttcccgcgcggttattggtcagcccgtggcgaattttcagcacgccgctggccgacagggcaatttcgctgcgcagttgcagacccgcctgcgcgtcttcgctggtgatgatcagcgtctggttatgctgctccacctgagtagtggtaaacaccggggaaccgtcgaggccgttgcggtggccttcaatgcccggcgaaccaaaaaggccatggcccggctccgccatcagcgtgatcggagcgtcgacgtccagttttccattggcgacaggacgttcaagactggctgcgtcctgcggcgaaaagtcggcaagatgcgtgccccagtaaagaatttcggcgaacggacgggttttgattaccacatccacggtggcgctttgcaggcgtaaaatcgacttttccatgcatcatctcctgagtattgatgatgtcatcgttgatccgaaacgtttcggatgccaaccaaaacgattcggatttgtgatcggcgtgggaatttaccgtaaagaaaggtgagtcaggcggtgacgcccggacggaattccggctgccacagtacctgtaatgtggcgagatcgtcaccggcaatcagccgccgtaccattccggcgatctgacggcccacgccctgacgggtggactggatcaccgccgccacgtccaggtcgacaatgctgtcggcgggcagcccgtcgtagacgatcagcgcgacgcggttgtcgcccgtcaagcgtccggcctgcgccagcgccatcgccgcgccgtcgccgtgggtgttgcagtcggtgataatggcagtgggcggctgcggcagcgccagcagttcgcgcgtggcgttatagcctgcccggcgcgacggcggcatgacgcgcagccattcacgggagaggccgctttcattgagcgcgttgagatagccgtttcgccgctgggtgataaaagcctgggtgttgttttcccccagcagcgcaatacgctggtgaccctggtcaatcagatggcgggtggcgcgccaggtaccggcatgattatcgaaatcaaaccaggcgtaaggctcggagagctggctgcggcccagcgccagaaaagggaaacgcgccgcctgcaactgctccagacgcgggtcgttatccagcgtgtgggcgacaatcagcgcgtccacgcggcgactctgcaccatgcgcatatagctgtgcttgtccgccagatcgtcatcggcaatcagcagcaggtcgatttcatgctgcgccagttcatggctgatctcccccaccatatccatgaaaacactgttattaagcggtacgggatgcaccggaaataccagcccgacggcgtcgattttgcccattttcaggcggcgggcgaaggtattgggacgatacccccggcgctgcgcttcagcctccacgcgggcgcgcgtttcctgcgaaacatcgtcataaccgttcagggcgcggctgacggtagttaccgacaggcccagttctttggcgatagcttttaacgacataattttccgtgtcagaggctgaagaatgccgctagtgtcccgcaaccttatcaggccgtccagcctcaaaataagcgcaaaaaaatgcctgcgggtgaaggcaggcattttctggcttacgacaactcagaaatagtatttgaagcgcacgcgcgcgccgtaacgatcgtcgtcgttattgctgctgttatccaccgtgtcgctgtcgagaatggagtagtaggtccccagatagatattaaagttcttcatattcatcacgttcgggatctgataagaagcaaaaatggtgtgaatatcgtaagtgccttcatcaaggacgaagttgtcatcgtcgccgatcacgccgtcataatcggtgattttgttatgggcatagacataacccagctcgaagcgtttccacagggcgttgatcccggcgctgaagtcctgttcatccgtggcgtccatgtaggcgctggtcaggttcaccaccacgccgttttccggatcggttttcagcccgtcccaggccatacgcagaccataaccggtgcggtcagactgatcgacaaattcaccctggctattagtgtaaccgtaggcgttattcaccacgttggtttccacggctgccgcaaaggtaagttcatcctgcgaccaggcaatcaccgggcgcagataggcgacgtttttctgctgttccatttcacggccatgatagagcctgccgtcaccatcatcgttatacagcgaggtgccatcttccagcagcgtgttcagctcgaaataccagttgtcgatctgcttgctcatcataaagctaccgcccgcatcggaacgtccgcgaccctctttcatcatatagatgtagccgctggtgtcgtcgtagaggtcgttggcggtattaccggaatgctcaacaaaggtatcctgattgagcgggaacatgtcgaaggcttcgaagcgcccgaccttcactttccagtcattttcctgaccaaagaagaaaacggcgtcatcaagatccatggagccggtcatgtctgccagcggctgggcggagaaaccggcgaaatagccgttatccattttccgcatgccgtcaaaacccaccagaatacggccattcaggtcccattgttcattggtgggatcgttgacgttggcattggtcatcgccaccaggccatgtttactttcggcatccatgttgaattccacgtcgccgtaaactttgatatcgccatagccggacagcaccaggttcggcgtggcggcattgtttttcagatcctccgccggttgttggccgtttaccggcgtgttgccctgcgccgctttaagttcgttaatttccgccgcctgctgcgtttttaattgctgcacctggctttctgccgccgccgcgcggttttccgctgccgccagacgttcttcaagctgctgtaaacgcgcttcaatactgctggtgctggtttttgcccagcccgaacccgcaaccatacttaaccctatcgccactgccaggagtgttttcttcattatttgcattccttgaaataaagtagagttcggtgttgctgtaataagcaacgccgtgaggtaatggatatttgcgatgaataatattttttatttattgattaaaacgaagcatagaattaatgaatatacttaccactattcctgttccgtaatattatcaatacaggcgcgaaaaatagtatgcccgcaccatgctgatgtaaacgcttacaatataaggatcgtgagcgggataacataagccgtaaaattgcaatactgcccggcgataactcatatgacagctaaataaatactaagttatttatcagactgctccggcaattatttatttttaatatggtcgggctaattaaaggaagcagtaactattcgggaaattaataatctctgtgatcagcgaacggataaataaactgtgccccttcccgcaaatttacctttttgctgcatgaaatatgtcatgcccggcggacatatctccgctcagcgccctgcccgcggccccttacaatcaggtgaacgagatcaacggagtgaaaagatggcgcacctcaccgcagactgcatcaacctcaacatcagcggcaacagcgcctattcggtgctgaaagcgctggcggatatggccgaaaaacagggagttatcaccgatcgcaacgcctttttacaaaccctgctgctgcgcgaaaaaatgcactccacgggctttggcgcgggcattgcagtgccgcacggcaaaagcgcctgcgtcacgcggcctttcgtgctctttgcccgcaaagcgcagggcgtcgactggcaggccagcgatgacgaacccgtaaactgctggatttgcctcggcgtgccgcaggctggggaagaggatcaggtgaaaatgatcggcaccctgtgccgcaaactcattcacgcggattttatcgcacagctcaaacagggcgacagcagccagatcctcacgctgcttaatcagaccctgggtgaataaggagccttccatggagacatcgttacgcctggtggcgatcaccaactgccctgccgggattgcgcacacatacatggtggcggaagcgctggagcagaaagcccgcgcccttggccacagtatgcaggtggagacccagggtgccagcggcgtggaaaaccgtctcagcgatgaggctattcgcgcggcggattacgtcattattgccaccggacgcggcctgagcgccgacgatcgtgcgcgcttcgcgggcaagcgggtgtaccagatccctatctcgcaggcgctcaaaaatatcgaccagatctttaccgacttaccggcgcaatcgcagcttttcgaagcggatagcagcgtgaagcttggcaaacaggaggtgcagcagggcagcgtgatgagccacctgatggcgggtgtttctgccgcgctgccctttgtgatcggcggcggtattctggtcgccatcgctaatatgctggtgcagatggggctgccctataccgatatggcgaaaggcgcaccctcttttacctgggtggtggaatccatcggctatctgggctttacctttatgatcccggtgatgggggcctatatcgccgcctctatcgccgacaaacccgccttcgcccccgcgtttctggtctgctatctggcgaatgataaaggcctgctgggcacgcagtccggcgcgggttttctcggcgcggtggtgctggggctggcgataggctatttcgtactgtggttccgcaaagttaagctcggcaaggcgttacagccgctgctcggctcaatgcttatccctttcatcacgctgctggttttcggcgtgctgacctattacgtggtcggcccggtgatgtccgacatcatgggcggcctgctgcatttcctgaataccattccgccgtcgatgaagcttggcgcggcctttctggtgggcgcgatgctggcgttcgacatgggcgggccgatcaacaaaaccgcgtggttcttctgcttttcgctgctggaaaaacacatttatgactggtacgccatagtcggcgtggtggcgctgatgccgcccgtcgcggcgggcattgccacttatctcgcgccaaaactgtttaccacgcaggaaaaagccgccgccagtagcgccatcgtggtgggcgccaccgtcgccaccgaaccggccattccctatgcgctggccgcgccgctgccgatgattactgccaatacgatctccggcggcattaccggcatgctggtgatcggcttcgggctgcaacgcctcgcgccggggctgggggtgtttgatccgctgattggcctgatgtctccggcgggctccttttacctggtgctgggatgcgggttgatgctgaatatcgtgctgatcattttattgaaaggattgtggctgaaacgtaaagccgcgcgacaggaggttgcccgtgaacactgaattactgaaaaacctgtgcgaagccagcgccgtcagcggcgatgagcaggaagtgcggcagctactgatcgccgcgctgacgccccacgtcgatgacatcgcctttgacgggctgggcagcctgatcgcccgcaaaggcacgcgcggcccgaaagtggcggtggtcggccatatggatgaagtcggttttatggtgacccatatcagcgagcagggatttatccgcttcgacactatcggcagctggtggagccagtcgatgctcaatcatcgcgtcaccatccgcacccgccacggcgagaaaatccccggcgtgatcggctccgtcgccccccacgcgctctctgaaaaacagaagcagcagccgctgacctttgacgagatgttcattgatatcggagcggcaagcggcaatgaggtaaaaagccgcggcatcgccattggcgattttatctgcccggaggcgaatttcgcccgctggggcgaggacaaaatcgtcggcaaagcgctggataaccgcgcgggctgcgcgctgatggcggaactgctggcctgcgtgaataacccggacatcacgctgtacggcgtcggcagcgtcgaagaagaggttggcctgcgcggggcgcaaacctcggcagaatgcatcaaaccggatgtggtgatcgttctggataccgccgtggcgggagatgtgccggggatcgacagcatcaaatacccgctgcggctgggggatggcccggcgatgatgctgttcgataagcgctattttccgaaccagaaactggtgcaggcagtaaaagcgagcgcgatgcgcagcaatacgccgcttcagtgctgcaccatgaaaaccggagcgacggacggcggacgctataacgtgatgggcggcgggcggcccgtggtggcgctctgtctgccgacgcgctatctgcatgccaccagcggcatgatatccgcgcgggattacgccgccaccctgacgctggtgcgcgatctgctgttatcgctgaatgccgaaaccgtccgcgcgctggcggattttcactgagaacgcctgatgctcaacgaacgccagcttgccgtgctggaacatctggaaaaccagccgctgacgctggcggaactggcgcggcgggcaggcgtgtcgacgcgtacgctgttacgcgatgtggattaccttaatctgacgctcagcggccgggcgcgcctcgtcaccaccggtaacgccacctggcagctggaaattttcgatcgcgccagctatttccggctgttgcagcgccacgacaacgacgatcgtctgctggcggtgctgctgcttaacgcctgtaccacccgccgccagctggcggaggcgcttaacctgccggaaacctggatcggcgataagctggcgcgtctgaaacagcgctgtgaaaagcgctttaccatcgccgcacgtcccggcgcgggctattttattgcggagccggaaatgaagcgggtgctaattctcgccagcctgctgaaaaaagatcccgctctgctggcgctgcatggccgcttttccactgcgggcgacgcggtggcgctggcggcgtaccctgatattccccgcgattatctctccggcataattctggcggtgtatgccctgcgccaccggctcgacgccccgccgcccgtcggcgtcagcgatgcgctcgccgcctctgtcaacgctatgggcctgtcgctgcatctgcctgcgctgcaaaccctgacagctattctggatacgctgcaatcccgcgccagtaaactcactccgcagcgcattgcagcattgctggagcaggtgcgcgataaccatccgcccgccattatcgacgccacgctgattgacaatcttaccgggcatttaattcgctgcgccgccacgccggtgtggttgacggaaagccgccagagcagccttaacacgctcaaagccgcctggcccgccgcctttgatatgagcatccgctttatcgccctgctacgcgaacagctggacgtgacggtgttcgacagcgatcttatcggcctctattttgcctgtagcctggagcgcaaccagaccgaacgccagccactggtcctgttatccgatcagaacgccatcgccaccatcaacaagatggccatcgagcgcgaggtgctgaactgccgggtggtgatcgcccgcagcctgagtgaagcagacgagttgctgcacagcctgtcgccggtgtgcattatcaacaacagccattttcgccctgacgacagcttcaaaaactgtctgaccctcaaaaacatgatcgggcctgcggggatcgcgcaaataaaagacgtggtggaaacggcgttcatccgccagaacctcaaccggctgtttccgtcgcagggcagttttcattatgtgaatacgccgtcgcaaagctggagcgcgatcatgcaggcggtatgcgggcgactcagggcggcggcgcgcataagcgaagatgaagcggtgcggctgtgtgaacgtgagcaggagggcgagaatttgatcgtcaatcagcttgccgttccccactgctggagcgagcatcgggcggctttttgcggctattttattacgctggcccatccggtcatcattaatcacgagccggtggcgcatatgctgattgcctgtgcgagcgcaacggcgcgacaggagctgaaaatttttagttttctggcaagcgtgatgcatcgttatccggcacagcggatcgcggcattagcgggttatgaggagtttatggcgttgatgcaggcgtaatacggggcgggaagcccgtccccgctcagcagagcagggacagcagctttgggacttatttattcagttcggcggtcatgtggatctggttaccggtgtaagcttcggtaattttgtaagacgatgcgccagcctgttgcgctttagccgcgatttgcgcttctgcaccggacagcgtggtggcggtggcggtcactgactgggcagcgaaagcaccgaaagaagcggtaagagcggcaactgcaactaaagttttgatgtttttcatgatgactatccttcaggttaatttgttgggataaggcgtctcgccttgatgtgataaatactagacctgtttatccccaacgaatagcggaaggatttgccgataaacttcaaaatttttgacgttcttttcagaggcctttcaggcgctgcggatgggtgtaaatcgtcgccctgcccggcttgcaaaatcccaccagcgtcagattgcagcgctccgcgacctcaaccgccagcgtggtcgccgcggagacggcaaagaggatctcaatgccgcacatggcggatttctgcaccatttcatagctggcacgactggaaaccagcgccgcgcctggccgccaggcttcaccttcctgcgcccgacgcccgagcagtttgtccagcgccacatgccgccccacatcttcatgcccgcccgccagttccccggacggcagcagccaggccgccgcatgggtacagccggtcagtttgcccaccggctggaaatcggtgagatggcgcagggcgtcatccagcagggcaagatcaaaggtctgggtaaagggcagcggcgcgaccggcttgccgatgtcattgagctgctccacgccgcacacgccgcagccggtgcgcccggccagcgcccgacgacgctccttcagccccataaagcggcggctggagagttcgatttgcacttccagaccgttgcagaccggcaccacgtccatgccgtagatctcgttcggcgcctcaataatcccttccgataacgaaaagccgagggcgaacagcggcagatctttgggcgaggccatcatcaccacgtgggagatgccattatataccagcgcgacgggcacctcttctgccagcacgtcgggctgtgaatgatgcaaatcctcacgcttccacagcgcgacggatcgggatccgatgagagcagtcacattttcctcttaatttacggcacaaattgttcactaattgttaaccaagccggaacaggcctaattacaatgtggtattcttccggtaatccccgcctcaaaacaggggatcccgtaattctgaacctttgcggcgcctgccgcaaagtataagtacgtgagtaaatgtcgaaataacgaaggagtgaccatgcaggtcagcagaaggcagttctttaagatctgcgctggcggtatggcaggcacgacggcagcagcgctgggctttgcccctggcgtagcgctggcggaaacgcggcagtataaactgttgcgcacccgcgaaacccgaaacacctgcacatattgctctgtcggctgtgggctgttgatgtacagcctcggcgacggcgcgaaaaacgcgaaagcttccattttccatatcgaaggcgacccggatcatccggtaaaccgcggcgcactgtgcccgaaaggcgcaggtctggtggactttatccactccgaatcgcgcctgaaatatccggaatatcgcgcaccaggttctgataaatggcagcgtatcagctgggaagaggcgtttgatcgcatcgctaagctgatgaaagaagatcgtgatgccaactatattgcgaaaaacgcagaaggcaccaccgtcaaccgttggctctcgaccggtatgctttgcgcatccgccgccagcaacgaaaccggctatttatcccagaaatttacccgcgcactcggcatgttagccgtcgataaccaggcgcgtgtctgacacggaccaacggtagcaagtcttgctccaacatttggtcgcggtgcgatgaccaaccactgggtcgacatgaagaacgccaacctcatcgtggtgatgggtggaaatgcggcagaagcgcatccggtgggattccgctgggcgatggaagccaaaatccataacggcgcgaagctgattgtgattgatccgcgctttacgcgcacggcctcggtcgccgatttctatgcaccgatccgccccggtactgacatcgccttcctgtcaggcgtgatcctgtacctgctgaacaacgaaaaatacaaccgcgaatataccgaagcctataccaacgccagcctgatcgtgcgtgaagatttcggcttcgacgatggcctgtttaccggttatgacccggaaaaacgccagtacgaccgcgcgacctggaactacgagctggatgaacgcggctttgcgaaacgcgacaccacgctgacgcatccgcgctgcgtatggaacatgatgaaaaaacacgtctcccgctacacgccggacgtggttgaaaacatctgcggtacgccaaaagccgacttcctgaaagtctgcgaatacattgcggaaaccagcgcgcacgataagaccgcctccttcctgtatgccctcggctggacgcaacactccgtcggcgcgcagaacatccgtacgatggcgatgatccagctgctgctcggcaacatggggatggcaggcggcggcgttaacgctctgcgcggtcactccaacattcagggtctgaccgacctcggcttgttgacgcaaagcctgccgggttacatgacgctgccgaatgataaacaagccgatctgcaaacttatctggcgggtaacaccaccaaaccgctgctggaaaatcaggtcaactactggagcaactacccgaaattcttcgtctcgctgatgaaggccttctatggcgacaaagcgacggcagagaacaactggggctttgactggttgccgaagtgggataaaggctacgacgttctgcaatatttcgagatgatgaacgagggcaaggtcaacggctatctttgccagggctttaacccggtcgcctctttccctaataaaaacaaagtgatcgcgtcgctgtcgaaactgaaattcctggtgactatcgatccgctgaacaccgaaacctctactttctggcagaaccacggtgagcagaacgatgtggatccgtccaccattcagaccgaagtgttccgtctgccgtccacctgcttcgcggaagaaaacggctctatcgttaactccggtcgctggctgcaatggcactggaaaggcgcggacgcccccggcgaagcgttgaatgacggcgagatcctggcgggtattttcatgcgtctgcgcaagatgtacgccgcagaaggcggggcgaatccggaacaggtgctgaacatgtcctggaactacctgacgccggaaaacccgtcggcggaagaagtggccatggaaagcaacggcaaagcgctggcggatattatcgatccggtcaccggcgatgtgctggcgaaaaaaggcaaccagttgagttcctttgcgcacctgcgtgacgatggcaccacctccagcggctgctggatcttcgccggtagctggacgccggatggcaaccagatggcgcgccgcgataacgccgatccatcgggcctcggcaatacgctgggctgggcatgggcgtggccgctgaaccgccgcatcctgtataaccgcgcctccgcggacccgcagggtaaaccctgggatccgaaacgccagctgttgtcttatgccaacggcaagtgggtcggggccgatattccggactacaacaccgcgccgccgggcagcgatgtgggcccgtttatcatgttgcaggaaggtgtgggccgtctgttcgcgatggacaaaatggccgaaggtccgttcccggaacactacgagccgtttgaaacgccgctgggcactaacccgttgcacccgaaagtgatttctaacccggccgcccgtatctttaaaggcgacgcggatgcgttaggaaaagcggataagttcccgtatgtcggcaccacgtaccgtctgaccgagcatttccactactggaccaagcacgcattgctgaatgccattgcgcagccggagcagttcgtggagatcggcgagaaactggcgggcaagctgggcatcgcccagggcgataccgtgcgcgtctcttctaaccgtggctatatcaaagccaaagcggtggtgacgaaacgtattcgtaccctgaacgtgaacggtcagcaggtcgacaccatcggcatcccgatccactggggttatcagggcgtggcgaagaaaggctttatcgccaacacgctgacgccgtttgtcggtgatgcaaacacgcaaacgccggagtttaaggcgttcctggtgaacgtggaaaaggtgtaacggagacgacttatggcttatcaatcgcaagatattatccgtcgttccgcgaccaacggtttcacccctgcgcctcaggcgcgggatcaccagcttgaagtggcgaagctcatcgacgtgaccacctgcatcggctgtaaagcctgtcaggtggcctgttcggagtggaacgacatccgtgatgaagtgggacacaacgtcggggtgtatgacaacccggcggatctgaccgctaaatcctggacggtgatgcgcttctcggaagtggagcaaaacgacaaactggagtggctgatccgtaaggacggctgcatgcactgcgccgatcctggctgtctgaaagcctgcccgtctgaaggggcgatcattcagtacgccaacggcatcgtcgatttccagtcggaacagtgtatcggctgcggctactgcattgcaggctgtccgtttgacgtaccgcgcatgaacccggaagacaatcgcgtctacaaatgcaccctgtgcgtggaccgcgtgactgtcggccaggagccggcatgcgtgaaaacctgcccgaccggggctatccactttggttctaaagaggatatgaaaaacctggcgggcgagcgtgtggccgagctgaaaacgcgcggctacgacaatgcaggcctgtacgatccggcaggcgttggcggtacgcacgtgatgtacgttctgcaccacgctgataaaccgaatctttaccatggcctgccggagaacccggaaatcagcgccacggtgaaattctggaaaggcatctggaaaccgctcgcggctgtcggctttgcggcaaccttcgcggccagcatcttccactacgtcggtgtcggtccgaaccgcgcagaggaagaggatgacaacctgcatgaagagaaagacgaggtgcgcaaatgagaaaacgtgacaccatcgtgcgctacaccgcgccggaacgcattaaccactgggtcaccgccttctgcttcgtgctggcgtcggtgagcgggctgggctttttcttcccgtcctttaactggctgatgcatattctcggtacgccgcagctggcgcgcatcctgcaccccttcgtgggtgtggtgatgtttgcctcttttatcatcatgtttttccgctactggcatcataaccttatcaatcgcgacgatattttctgggcgaagaacattcgcaagatcatcgttaacgacgaggtgggcgataccgggcgttataatttcggccagaaatgcgtgttctgggcggcaattattttgctggtgctgctgctggttagcggggtgattatctggcgtccgtacttcgcgccggtcttctccattccggtgatccgatttgccttaatgctgcattcatttgccgcagtagggttaattgtggttatcatggtgcatatctacgccgccctatgggttaaaggcaccataaccgcgatggtggaaggctgggtaaccagcacgtgggcaaagaaacatcacccgcgctggtaccgtgaagtccgccagaaagaggataagtcacctgaatgagtattcgcataatcccgcaagatgagctggaaaaaagcgagaaacgcgcggcggatatgatcccgccgctgcttttccccaggctcaaaaatctctataaccgccgtgctgagcggctgcgtcaactggcggaaagcaatccgcttggcgattatctgcgctttgccgcgctgatcgcccacgcgcaggaagtggtgttgtacgaccatccgttacagatggatcttaccgcccgcatcaaagaagccaacgaccagggcaagccgccgctggatattcatgtcctgccgcgcgatacgcactggcataagctgctgcattcgctgatcgccgaactgaaaccggagatgagcggtacggcgctggcggtgatagagaatctggaaaaagcctcgtcccaggagcttgaggcgatggccagcgcgctctttgcgacggattttgcctccgtcagcagcgataaagcgccctttatctgggcagcgttatcactgtactgggcgcagatggccagcctgatccccggcaaagcccgcgcggaatatggcgaacagcgccagttctgcccggtgtgcggctcgatcccggtttccagcatggtacatatcggcaccacccaggggctgcgttatctgcactgcaacctgtgtgaaaccgagtggcatgtggtgcgcgtgaagtgcagcaactgcgagcaaacgcgcgatctgcattactggtcgctggacagcgagcagtcggccatcaaaaccgaaacctgcggggattgcggtacttacctgaaaattctgtatcaggaaaaagacccgaacgtcgaaccggtggcagacgatctggcctcgctggtgctggacgcgcgcatggagcaggaaggctttgcccgcagctccatcaacccgttcctgttcccgggtgaaggtgagtaaatagccgtagttataaaagcccgccctgtgcgggcttttttattgcgttcgcgctgctttgcgaggcgctttcagaaatcgtgatcacacttttacatcccttacgcatccggctataacgctgtggattgggagcgtggcgtggtggattttccatgcgatcgttccggtttaagacccggagtgctatcttgtgttaatagataacacaggaggaaaaaatgcccagaacaaccagcataacgattggggaccatttagatcgttttattagcgagatgattgaaagcgggcgttatggttcaacaagcgaagtcgtgcgttccgcgttacgtttgctggaagaacaggagttacacaatggtaagttacgcgaagcgctggaaaagggacttaacagtggggaaagcccgttaactttgcaggaaattgcgacaaggaaaaaacgcagcttaaatgtataaactctccaggctggccgccgaggattttggtgcgatttatgaatattcctggcgtcaatttggcccattgcaggcagataaatacaccgctgaactggatacgtttctaatgctactcgctcaaaaccctttgatggggcgcgagataaatattattgaagatgttcgtcgctacgatcacggtcagcacgccattttttatcagatgcagaatgacgggatttttattgcccgcattctgcatcaacaaatggaccctttaaagcatctgaaatgagccctactcttcttcgttaccgccctcttccagcggtccgaagggtttggcgggcagcacgatatagatgccttcaaaaatcgcgcccgctttatcgtcgccaaagagctcgacctggagctgaacgcgggatttacgaccacgggccaggcggtccagatcgccgctgagcgagcctaaatccgcaaccgcgctcgggcgtccgctgatcggctggctgtaacgaatatgcgcatccgccagaataatggtgccgcccagatgacgctcgcgcagcatcagccagatcagcccccagccggtgagcgtggcaagtgagaacagactgcctgcaaacagcgtgttatgcgggttctgattgcccgtctccggcatggtggtaataaatttttgcccggtgtactgctggatgcgcacgcccattttttcactgagcggaatatgctgataccaggcctgctgcaactgcccgcaccagtcgccgcgatgcagaatatcatcgagcgaagcgacgggtttcaccatcaaaaaatggcgcagcggcgtggtctgcggcgcggtgatctcgccttcgttcacaaagccgagcttggcgaaaaactccacggcgtcttcccgcgcgctacaggtgacgcgctttacgccctcctgccgggccacggattccagcgtcatcgccatcagcgtgccaaggcctttgtcctgcacgctgggatgtaccgccataaagcggatcgaggcttcattgtcggcattgatatacagtcgcccgacggccaccagcttgccgtcttcgtccatcaccatctggtgatgcgccatcgcatcccaggcatcgcgctcggagccgcgcggctggcgcagcggcttacgcagcatttcccagcgaaaggcgtagtaacgttctaattcttcttctgtctgcggtacgcgtaggtggtacatagcggtattctctcttgttgaccggggcaacaccgcaagctgactcatacctggagccagaacgttacggggccgtcattcaccagcgaaacctgcatatcggcagcgaatcgtccggtttgcgtcaccatatcgaggctgcggcaacgcgacacgaaatagtcatacagcgcttcggcacgctcaggttcagcgccttttgagaaccccggacgcatgccgcggctggtatcggccgcgagggtgaactgcgacaccaccagcacgctgccgccagcctgtttaacgttgaggttcatcttgccgtcagcgtcgctgaacacacgatagccgagcacccgttcgcacaggcggtcggctttttgctcgtcgtcatccttttcgacacctaataacaccaaaagtcccgggccgatttcacccgtcacttcatcctccacgctgacgctggcgcggctaacacgttgaatcaatgcaatcatggttggtctgcttgtgcttcttctgcggcttctttgagtttgcggtattccccgagagtgacagttatttccgcgccaagcaagacgatacaccacgtccagtacacccagaggaataaaatcggcaccactgccagcacgccgtaaatcagctgataagaggggaacatggtgatgtagagggcaaaagcttttttgcccagctcaaataacagagcggcgaccagcgcgccgacaagggcatcgcggttcggtacgcgcgtggtcggcacgatgctgtacagcagccagaacgacagccaggagaggatcagcgggaaaatccgcagcacgtcgtcaatcacgctgtcgagatcgctcacccagcgcagggagagcagataggaactgatagccaggctcgcgcccgccagcagcggccccagcgtcaggatcatccagtacaccgcgaaggagtaaaccttcggccgtacccgtttactgcgccagatgacattaagcgcgctgtcaatggcatacattaacagtaaagaggtgacgatcagcccgcatgcccccaccgccgtcattttgctggagttagcgacaaactgttcgatataacgctggatcacatcgccggtggcgggcatgaagttggcaaaaacaaaatgccgcaactggatactgacgtcattgaacatgggaaaggcggcgaaaagcgcgaaaatcaccgccaccagcggcaccagcgagagcagggacacataggcgagattccccgccagcgtcgtcatattgtcttcatcaatacgctgccagagcaatttgagccaggccaccaccggtcgggtatgatgcctggctttatgatgaacggtttttaacataactgcttcgcaaaataggtcgggagagtgtctttaccggtcaccagaatggaggtgatccccagctggttagcgccttctatattatcggcgttatcgtcaaaaaagaccgtatcggcggcgctaaatccttcggcctgtaacaccgcctgataaattcgtgcttcgggtttacgcatccccatatcctgggacaggtaaatatgatcggcggcagctttaatttccggatattcctccggccagaaagtcgtgtgcagacgattggtgttggacagcaccaccacgcggtgcccctgggcgcgcagtttatgcatgatgtcgatcacctccgggcgcagcgcaacaaacaccgcctgccagccgtgggaaaattgctcgtagctgagggggagatccatttcccggcacagcgcttcggcaaaggcttcatcggtgatctccccgcgctcatgctgatggaaagcctcgcccatggtgaagctctgcttgagcgtcgccagcggcacccggctgaaatcgctccatgcgcccagcacccgattgaagtcaatatcgacaatcacattacctaaatcaaagatatagagcatttccctctccttatcagccgtggaaggataactgtagcgggaaatgatgagggtgaacagtcgggcagtgcgggatcgatatatcaggcaagttaactgtgttttcgtgcattgcgccgggtggcggcttcgccttacccggcctacagcatcgatgatactcgtaggcccggcaagcctgcgccgccgggcagagaagaaacgaattattgcatctttaaaacggcagtcgcgtactgccgcgcggcacgatctcaaatcccgcgtcgacgatatcgccctgccagctgcggtcggcgctcatacgcagcatcatttccgcggtgcgggcggcaataatgctggcgttgaggttcacgctggaaagggtcaccggcgacagccaggcgctggaggggaaatccccgtagccaagaatactcagcttttcgggtacggcgatgccgcggctttgcgcttccatcagcagcgcggtggcaatggcatcgctggtacaaaaaatgccgtccagcccgcgcgttttcaccagcgtcgggataaggatttcccggctggcctgccagatattttccgcacggggaatatccaccagcagggcgcttttcccctgctcttccagcgcgcggctgaaaccggcgtagcgaattcgcgcccgaatatcatcctcaaagcgggtggtgaaatacgccagctcctgacagccggaatccagcagaaaacgtgccgccgcatagccaatttcggtgtgattattgccgacctgcgccgggaacgcgccgccgtccacctgccacatctgcaccaccggcacgccgctgttgcgcagcatcttcagcgttgacggtttatggtctgccccggcaatggcgatcaccgccggggaccattgcagaatcgagcggatctgttcttcttctttatcaaggctgtgatcgtgggaggcgatggacagctgaaacccctgcgcgctcaccgtcgattcaatgcgctgcaccacgtggctgaaaaaactgttcgccagcgacggcagcacaatcgccatattgctgctctgtccgccggtaaactggctggcgattttgttgtgcacgtagcccaggctgtcgatagccgactgaatttttttgccggttttttccgacacgcgatcgggctggcggatataaagcgaaaccgtggagggcgagacgccagccttcccggcgacatcatcaagttttacgatttggcgtgatctctggcgcattccactcccgtcttcttatttcgcgttaacagccgcatcagcagcaacgccccggcccagacagccgtaagccaccagacgaaactgtcagggatccccgtttccgcggcaagaccgagcggggataaggtcataaatatgctgattaaaacggccatcatgataacacttgccgggatggcataacgccatttttccattggtattctggcgggcgccgcctccggctcctcccagcgcgcaggccacagatatcccatcagcaacaggatcgccagttcaataacgaacagcagtcccatcacgtggatatagtgcagcggaataaatttttgcaccccgctgaaggtatagatcgcataaacaacaatatgaaaaatcagcactgtttttgccgctcgcgccggtacgttgcgcgttaaaaatcccgccagcaccagagtgatgatcgggatgttataaaagccggtaaagcggcgcatcaaatcaaagatgccgttcggcgtatgcagcagcaacggggccagcacaatagacaccagcgaaaacgccagcgaggcgattttccccacccgcaccagttttgcctcgtcctgacagccggtgagggggccatagagatcgataacaaacagcgtggcgctggcgttaataatcgaattgaaatggctgatcaccgtgccgaaaatggcggcggtgaacatgcccgtcagccaccatggcagcagcgctttgaccagcgccggatacgcataatccgcattgctgaacaccgggccaaacagattgaaggcgatcagccccggcagcaccatcaccagcggcaccagcagtttgatactgcccgccagcagcacccccttctgactttcggccagtgacgacgcgcccagcgtgcgctgaatgatcatctgattagtacaccagtagaacatattggcgcacagcatcccggtaaataccgtactaaacggcacggacgcggtttcactgccgatggcgttcagctgcgccggatggttcagcaggcgcgttgccccgctgataaaagcgccgtcgcccagcgcgaacagccccagtacggggatcagcagcgcggcgatcagcaaaatcacaccgctgatagtgtcggagatggccaccgctttcaggccgcccagggtggcgtacagcccgccaattgcccccatcgccagtgccagcaggccaatggcgctccaggcgggcagatgaaagaatgactgaaaatcaaagatttcgttcatggtgagcgcccccagatagaggctgcacgggttcgccatcaccgcatagcccaccagcagcataatgctcaccatccgccgggtcgtctgatcaaagcgcgtttccagaaattgcggcagcgtggtcagtccgcgacgcaaaaagcgcggcagaaaaaacagcgccatgatgatggtcgccacggcagcggtgctttcccaggccatgccgctgatatcaaagcgatacgcattgccgttcagccccaccagttgctccgccgacaaattagacagcagcagcgatccggcaatgaaataccccgacaacccccgcccggcgagaaaaaagccgtccacacccgcttctgaaatgcctttggttttgcggtatgagtatagcgctacgaaaattaagaaaagtaaaaacgacgcgacagaaaatagcatctgcataacaccaccctccctgagcatgcggttccattactattccacagcctttccccgacagataacgacaacagacgggaaatttgagctggcctgtcaaaaaccatactcacggcaagggaattgcgggggctatcacaaaacagggctaagccatcttgaatatcgtagcgctacgatattaccgtataaataaacctacaccggagtacttacatgatgttcaacacagatcgcttaccacgccgtgagatcggtgaactccgcagccagcgctggtacgcccccgataccatccgggcgtttgcccaccgccagcgcacacaacaaatgggatttggccgggacgagtttctcggtaagccggtcatcggcattatcaatacctggagcgacatgagcgcctgccatgcgcatttacgcgagcgggctgaagccgtgaagcgcggcgtctgggcggcgggcggttttccggtggagctgcctgcgctgtcgatgggcgaagtgatggtgaaacccaccaccatgctgtaccgcaatttcctggcgatggaaacggaagagctgctgcgccagcatccgatcgacggcgtggtgctgctcggcggctgcgataaatccacccccgcgctgctgatgggcgcgctgtcgatggatttgccgctgatcttctgccccgccgggccgatgaccaccggcaaatggcgcggccagaccacaggcgcgggaacgcacaccaaaaaatactgggatcagctgcgcctcggcgccattacgcagcatgactgggtggagctggaaggggcgatgacgcgctccatcggcacctgcaacaccatgggcaccgcgtcaaccatgacctccattgccgatgccatgggttttacgctgccgggtgccagttccattccggcggcggacagccgtcatccgcaaatggcggcgcagtgcggccaggccattgtcgatatggtgtggtacgaccataaaccgtcccactggctgacgaaaaagaatttcctgaacggcatcgtcacctatatggcgctgggcggctccaccaatgcggcgatccacctcattgccatggcgaaccgtgccgctattccgctgacgctcgccgatatggaagccatcgcccgccgggtgccggtgctcgccaacctgttcccgtcgggaaaatacctgatggaggattttttcttcgcgggcggcctgctggcgcagctgaaaaagctcaccggtttcttgcatctggatgcgcggggcgtcaccaaccggccggtcagcgcgtggatcgaacaggcgcactgctatgacgacgacgtgatccgcgatctgcaaaatccggtcattccgctgtcacagggctgcgcactgacggtgctgcgcggcaatttatgcccggatggcgcggtgatgaaatcctccgccgccagcccgcagctgcgcaaacacaccggtcctgcgctggtgttcgacagccatcaggcgctgtcggatcagattgacgaccccgatctggcggtcactaaagatacggtgattatcctgcgcaatgccgggccggtgggcgcgccgggcatgcccgagtggggcaacctgccgatccccaaaaaactgctacgcgagggcgtgaccgacatggtgcgtatttccgatgcgcggatgtccggcacccattacggcacctgcattctgcacgtcgcgccggaagcggcggtcggcgggccgctggcactggtgcaaaccggcgatcgggtgacgctcgatattgaggcgggcacgctcaatatgctggtggacgacgacgaaatagcccgccgccgcgcggcacttaccccgcagcacactgtttttgcgcgctcctgggcggcgctataccaacagcacgttacccaggcgaatgaaggctgcgattttgattttctgcaatccggcggcgatgtccctgaaccgcccattttttaaggaaccctgatgaacccttttaaacacgccctgctttcaggccagcgcctgctcggcacctggatgatgaccggcagcgataccgtcgccgaagcaatggcgacggtcggattcgattttctggtgctggatcaggaacatgtcgccgtcgatacgctggacgccatacgcattgatcgggcgatccgcagcatcagcgccaccaccacgccgctttaccgcctcgcgggaaacgaggtggtgcttattaaacgcgcgctcgacggcagcgcgatgtcgctgatgatcccttttatcaacaccgcggaagaggcgcagcaggcggtggtcgccgcttattacccaccgtatggcaaacgcggctttgccgccatgcaccgcgcctctggttggggcgggaatgcgcagtttgtgcaggaggcgcgggacgaactgtgcctgatcctgcaactggagacgccggaagccatcgccagtatcgatgccatcgctcaggtggacggcattaccggcttctttatcgggccgggcgatttgtcagcggcgatggggcagccgggcaacccgtcgcacccggaggtgcagctgatgatcaagcgcgggctggaggtctgtcagcgcctcggcaaaccctgcggcatcgtcggtggcaatccgcaactggtgaataagtaccagcagatgggctttaactttgtggcgctggcctcggacatgagctttatgctggcgcgcgcgaaagagcagctggcggccattcgcggagaacagctcaccattcgcggcggggaggtgtactgatgacccggcttattgaaggtaaatacggcgatatgcatatcgccgtcgcgccggagttgggcggtgcgcttgcctggctgcgctggcgcgggcacaacattctgcgccctctcgatccgcggggcgcacagcgcgccaatatgtgcggcagttatccgctgatcccctggtcgaaccgcattgccgacgggcgcttcgcctttgacggccagccttttcaggtgacgcgcaacgtgccggataatccgcacgcgctgcacggcatcggctggcagcaaatctgggaggtgatctacgcgagtgaaacgcagattgatcttgcgtttacctgcccggcctctgtccgctggccatggccgtggcgggccagccagcgttttgcactgaccgaaaatgacctcagcgtgtcgctgacgtatcacaacctcgcggatcaggctgtgcccgccgggctgggctttcacccgttttttgccgacgccgcccgcagcgaggtcatgtttcacgccgcccacgtctggctgaacgatgaaaacagcctgccggatgaggaagtcgccgtgccgcccgcgtgggactacacgcgctttaaaacgccgctcgccggctcggtagacaactgttttaccgactggaacggcgaagcgatcgtgtgctggccgcagcgcggcatccgcgccaccttgcacagcaacacgccgaatctggtgttttttattcccggcgacgggcgcaacgtggtggcgatggaacccgtcagccatatcaacgacgccattaaccgcttcccggcaggcagcaacgtccaggcaatggatcgcatcgcgcccggcggcgagctgtcgctcagcatgacaataaggatgtcagacgatggaacaaccccgcgtactctttgactatcacggcgagctgccggaatgcccgacctgggatgccgaccgccagacgctctactggaccgatattttgcgccaggaaattcatcactatcagccgcacagcggcaagcacggcgtgatgcactttgccgaagaagtgggctgctttgccctgcgcaagcgcggcggtctgatcgtcgccatgcgttctgccatctggctgaccgatggcgaaggcaggctgacgcagaaagtgtgcgataacccgaataacccccagctggcgcgctttaatgatggcggcaccgacggccagggacgcttttatgccggaacctactgggggccgcgggattacaacggcgcgctgctgtgccgtgtagacgccgacctgaaaaccacggtgttacagtccgacattctgggcgcgaacgggctggcgttttccccggatggccggtggatgtacaccagcgacacgccgaatcatgtgatttatcgcacaccgctggatgcgcacggccagcccggtcagcggcagatctggaaaaccttcccgcgcggcaatggcagaccggacggcgcggccatcgacgctgaaggctgctactggagcgcgctgtttgacggctggcgtattgcgcgcttttcaccgcagggcgaggtgctggcggaaatccggctgccggtgcgctgcccgaccatggtctgcttcggcggcagtgacatgaaaaccttatttattaccaccacccgggaaaatatgtccgcagaagaaattaacgctcacccgctgtcaggtgcgatattttccctgcgcgttactgtccccggcattcagaaattaaaatttaacgagaactgaaaaaaatgaaaaccattggttttatcgggcttggcctgatgggcgaagccatgtccaaaaatattgtcaccaaatttaccggtacggttctggtcttcgatattaatcaggacgccattaaccggctggtattacagggcgcgcaggcggctatttccgtggcggatattgcgcagcgtgccgacgttattatcagcatggtgccccgctctgaacatgtgcgcgatatttatcagcaaatgctgccgtatttacatgacgggcaaatcaccattgatatgtcgactatcgatccctccgtgtcggtagccatttcccgccaggtgaatcataccggcgcaatcatgctcgacgcgccggtggtgaaatcggtgcctgccgcgcagaagggcgagctgggtatttatatcggcggtgataaagcagcatgggaaaaggtgtcgccgatcctcgcgatgatgggtaatcaccagatccatatgggcgggaatggccgcggcctggtgatgaaaatcgtgcataacctgctggtggcgggcattcagaacagcgtcaatgagatgctgaccgtggcggatcattacggcatcgataaagcggattttcataaagccatctcgtttggcggcgccaccaactggtatctcgacagcaaaattaacagcctgatcgccgaagatttccgcaccgccttctctctgcaaaatatggccaaagacgtcaacatcatgaaatcgctgctgacagaagccgggttatttctgccgggcgtgaatgtggtgaaaaacgtgtatgaccagggaatggaaaacggcctgggtggcgaagatttttctgccacctggaaagtcgttaagcacagcgccagaaaataattgaggaataagattatgcacagcgaaatcaacgtcatttataaaagtctgcacaataaagtcgtggccattaccggcggcgccagcggcattggcgaagaatatgtccgcgcctttgtgaatcagggcgcgcgggtggcctttctggattatgacgcccgggccggtgagaaactggctgcggaaatgggatgtctgtttttattttgcgacgtcacggatattaatcagcttaaagcctgttttacgcagattatcgaacagctgggcgatattgatattctgattaataacgcaggcagcgacgatcaccatactattgatgatctgacggaagactattttaataaccgtattaacgtcaatatgcgtcaccacctgttcgccattcaggcggttattcccggcatggcgcgcaaaggcagcggcagcattatcaatatgggctcgattaactggatgcgcgggcgtccgggacgggtgtgctattccctgtcgaaagcggcgattcacggctttacccgcacgctggcgcaggagctggggccgcgtgggatccgggtgaacagcctggtgccgggggcgatccgcactgccaaacaggacgcgatgtgggcgaaactcgatccggcggcggtaaatcagtttatcgaactccaggcgctgaaattccgtctcgacggcacgcactgcgcgcggctggcgctgtttctggcgtccgatgaatcctgcggctgcaccgggcaggactttatcgtcgatgcgggcttgtcgctgaattaaggagcggatatggacttctttagcttgttcacacctgatggcgtgatgctggaaaccggcgcggtgctgattgtggtggcggtgatgtttctttacaccttcgtcgggatttgcgcggggtttggcggcgggctgaccgccatgccgctgatcaccatggtgctgccgttaaaaatggcggcgccgatgtcggtgatggtcggcacggcgacggcgctgtacgccacctggctgtcgcgcaaggaaaccgactggaaatcggcgctggtgttgattgtgttctctctggcggggatcccggtggggctgtatgcgctgtcgtttctgcccgatcacattatgaagattggactcggcgcttttatcattctctattcgttctacagcctgtttattccgcgtctgccggtgtacgacaaacgctggattgccgcccctatgggcgccatcgccggagcgctgggggcggccttttccaccaacgggccgccggtagtgatgtacgggatgctgcgtaatctggcccccgccgcctttcgcggtacgctgaacgccttttttacggcgaacaatatcgcgattattggcgggctggccaccagcggtattctgaccatttccaccgtcaagctggtgattttctgtattccgaccatgatcctcggctcgctggtcggccagtacgttcacaagcggatttcggtgaaagtgtttcgcctgatggtgtttttgctgctgattgcctcaggggcgatgctgataaaaggggcaaccgggatctctgccgcaagcgccctgcttccggcgtttgggctgctggcggttctgcaactggcatttgggcggaaagtcgcggcgatacgcgcggcggaggaggcgcggtagtatttttgcgttatatgccgggtggcggcttcgccttacccggcctacaaaatcagtgataccgtaggcccggcaagcatgcgccgccgggcgatacgtggcggcttcgccttacccggccaacaaacctacgaatcggtgataccgtaggcccggcaagcgtgcgccgccgggcgatgcccgctcgttacatctcatcgtccggcgaggcgaggatcagctcgatttgcttgtttttcatcaggctgtgcagcgcctgcggcggggctttgtcggtaaagagtgccgtggcctgggtgacgttgccaatttccacggcggcggaggcggtgaatttggtgtgatccaccgccaccaggatttgccgggagtgggccatcatggtgcgggcgacgctggcttcattgacgtcaaactccagcagcgtgccgtcgttttcaatcgcgccgaggcttgtgatcaggtagtcggcgcgaaacccttccacaaaggataccgcgtgcggcccgataataccgctgttatgcggccgcagcgtgccgccgggcaccatcacttcaaagcgggtatttttgtagagaatatgcgccacccgcaggctgttggtgatgatgcgcaggtggttgtgattgagcagcgcccgcgcgatatgttccaccgtggtgccaatggtaatgaaaatggtcgacccgtcggggatatagtcggcaatggcttcggcgatggcttttttctcagcggtcagcgagatttcccgctcttcaaaggccgtgttaaccacgctcgacgcgcggcctgcgccgccgtgatgacgggtgatcagaccctgctcgctgagcttgcgaatatcgcgccgcaccgtctgcgtggagacatccagcagttgcgccagttcatcaatgttcatgtaaccgcgttcagcgatcaacgccagcagttgatcgtggcgcgggttgccggtcagctcggtggcactcatgcgtttccctcgtaacctcatcgttaatgggtcattttatacataaagtgacaaaaaagaccggacttgatcacaatcagggatgccgtcccgtccgccggggcgggtgcatttgagcgccgccacgccgctggcgaagcggacggcatcattgatgggctgctgttgcgccaggctgaacgccagcgcgccgtgaaagacatcgcccgcaccggtggtatccgccacatccacgcaaaaacccggttgatgatgatgttcagcgccggtcataaaatgacagccctgcgccccgctggtgacataaacctgcccgtcagtgacggtgcgggcgtactccagcccggccagcggatcatcaagaccggagaaccgccgcaggcccggcgcggaaaagacggcgtgatcgctgagcgccaccaggtcgtcaattttttgcggcgttacgtcgccatccagcagggttgttaccccggcctgttttgccagcgtgaaggcgcgtttcgccccgtcatgccagcgtacatccgccagcaccaggtcccattgtgaaaaatccagcgcatccagccagtcggcgtcaggcggcagatccgggccgggatagttaatgatgatccgctcgccctgcgcatccaccagcacggcagattgcgaggagctggcatttttgacgcgccgacaaaagcgggtgtttacccccagggactccagttccgcgagaagcttgtcgccagtatcgtcatcgccggtgcggccgataaagtccacctgcgcccccagttttgccgccgccactgccgccgtagccgccgggccgccgcccacttcccgatagtgatgcgccacatatttgcccccctccgtgggtaacgcttccacattgtagatccggtccatcacggttattccgacgcagacgatacgcaccatggtcattccttaaacgagtaacgatgccgtcattttaatttgccggattgttaaaaaagtgacggctgtcaattttttgaccataaattacaaatacgatcaaaaacagacacaaaagagcacgacgagagacataatctgacaaccagtaacgacgggagagtgaaatggccagcattgcgtttattggattagggcagatgggcgcgccgatggcgacgaacctgctgaagaaaggacatcacgtctgggcgtttgacgtgaacccggcgtcgatggagggcgtgatccgcgaaggcgcggtagggtgcagctctccggcccaggcggcggagtttgccgagttcgtcatcaccatgctgccaaacggcgatctggtacgtcaggtgctgttcggcgatggcggcgtctgcgaaaccctctccacgcgcgcgctggtgattgacatgtccaccattcacccgttgcagaccgatgccctgatccgcgagatgcaggcaaaaggatttcagatgatggatgcaccggtgggacgcacctccgatcacgcagtagccggtacgctgctgttacttgcaggcggcacggctgagcaggtggagcgcgccagcccggtgctgctggcgatgggcagtgagcttatcaacgcgggcggccccggcatgggcattcgcgtgaagcttatcaacaactacatgagcatcgcccttaacgccctctccgctgaagccgcggtgttgtgcgaggcgctgggcctgtcgtttgacgtggcgctgcaggtgatgagcggcaccccggcaggcaaagggcatttcaccacctcgtggccgaacaaggtgctgaaaggggatctttccccggcctttatgatcgacctcgcccataaggatctggggatcgccctggacgtggcgaatcaactgcatgtgccgatgccgctcggcgcggcgtcgcgggaagtttataacctggcgcgcgccgccggacgcgggcgtcaggactggacggccatcctggagcaggcccgcatcagcgccggcctcgcccctctcgtatcccagtaatgctgtaaaaggaccgatgtatgacgacttacacgcttaaagatattacccgcccttccggcggctttgcgatgctggcggttgaccagcgtgaagcgatgcgcctgatgttcgcggcagccggtgcgccacagccggtggctgaccatgtgctgacggattttaaagtcaacgccgcccgaaccctgtcccccttcgcctcggcgatcctcgtcgatcagcaattctgttaccgccaggtggtggagcagaaagcgatcgccccatcctgcgggatgatcgtcgccgccgatgcgtttattcccggcaacggtatcccggtggacagcgtgatcatcgataaagcggtcgatccgcaggcggtgaaacgcgacggcgcaaaagcgctgaaactgctggtgctgtggcgcagtgatgaggacgccgatcagcgtctggcgatggtgcgggaatttaatcagctgtgccatgcaaacggcctggtcagcattattgagccggtggttcgcccgccgcgccgtggcgataaattcgatcgcgagcaggcgattattgatgcggcgaaagagctgggcgacagcggcgccgatctctacaaggtggaaatgccgctgtgcggtaaaggcgatacgcagacgctgctcgccgcgtcccagcggctgaacgatcacatcgccatgccgtgggtgatcctctcctccggcgtcgatgaaaaactcttcccccgcgccgtgcgcgtggcgatgagcgcgggcgcgtccggttttctggcgggtcgcgcggtgtggtcgtcggtggtgggcctgccggacaccgaactgatgctgcgggatgtcgccgcgcctaagctgcaacgcttaggggacattgttgacgaaatgatggcgaagcgctgaggaggaacagatgaaatggtttaacacgctgagccacaaccgctggctggaacaggaaaccgaccgcattttcgacttcggtaaaaaggccgtggtgccgaccggtttcggctggctgggcaataccggtcaggtcaaaacggatgtgggcacccacctgtggatcaccgcccgcatgttgcatgtgtatgccgtggccgccggaatgggccgccccggtgcgtatgagctggtggatcacggtattaacgcgctgaacggcgcactgcgcgataagcagtacggtggctggtatgcctgcgtcaatgatgaaggggtgatcgatgcttccaagcagggttatcagcatttctttgtgctgctgggcgcggcgagcgcggtaaccaccgggcatcctggcgcgcgtccgttactggatgacgccattgcggtgatcgagcgttatttctggagcgaagcggagcaaatgtgccttgagtcatgggacgaggccttcagcaaaaccgaagattaccgcggcggcaacgccaatatgcacgcggtggaagcctttctgattgtttatgacgtcacccatgaccgcaaatggctcgaccgtgcgctgcgcatcgcctcagtgattattcatgatgtcgccagaaagagtgattaccgcgtcaacgagcatttcgacaaccagtggaacccgatccgcgattacaacaaagacaatcccgcccaccgtttccgcgcctacggcggcacgcccggccactggatcgaatggggccgtctgatgctgcatctgcgcgccgcgctggaagcccgctttgaaatgccgcccgagtggttactggaagacgcgaaaggcctgtttcacgccaccatccgcgacgcctgggcgcccgatggcgcggacggttttgtctattccgtcgactgggacggcacgccgattgtgcgcgagcgcgtgcgctggccgatcgtcgaagctatgggcaccgcttacgccctgtggagcgtcacgggcgacgcgcagtatgaagcctggtatcagaaatggtgggattactgcatgaaatatctcatcgactatgaaaacggctcgtggtggcaggagctggatacggataacaaagtcaccaccaaagtgtgggacggcaagcaggacatttatcacctgctgcattgtctggtgatcccccgcctgccgctggcgccgggtctgggccccgccgtcgccgccgggcttctggattgcaacgctaaataaacaataaaacttacagaggtcattatgcgtaccctacaccctgacttatccgctctggcgctgaccaccagcgctggcggctttaccttaacctaccagcagcgcctgatcctgcgtcatacgccggacgccgcctgtttatggacaggcgctggcacggcggatattgagatgttccgcggcaacttcagcattcaggatcggctgaatgaaaaaatcgccctgacggacgccaccgtacaggcccatgacgccggctggacggtgcgcttcggccgcggcgatgcggtgagcgcgacgctgaaaattggcgtcgatgacgcaggccgtctgctgctgacgctgcaaaacgatgacgcggcccataaccgtatctggctgcggctggcggccaatcctgaggatcatatttacggctgcggcgagcagttttcgtatttcgatctgcgcggcaaacccttcccgctatggaccagcgagcagggcgtgggccgcaataagcagacgctggtcacctggcaggcagactgcaaagagaatgcgggcggcgattattactggaccttctttccgcagccgacctttgtcagtacgcaaaagtattactgccacgtggacaacagctgctatatgaatttcgatttcagcgcgccggactatcacgaactggcgatctgggaaaatcaggccacgctgcgtttcgaatgcgcgcccacctacattcagctgctggaaaaactcaccgcgctgctgggccgtcagccggagttgccggactgggtgtatgacggcgtgacgctcggcattcagggcggcacagacgtgtgccagcaaaagctcgataccatgcgcaacggcggcgtgaaggtgaacggcatctgggcgcaggactggtccggcatccgcatgacctcctttggcaagcgcgtgatgtggaactggaaatgggacagcaataactatccgcagctggattcccgcctcgcgcagtggaaggaagaaggcgtgcagttcctctcctatatcaatccctatgttgccagcgaccgcgagctgtgcgcagaggcggcgcgcctcggctatctggcgaaagataaagacggcaatgattatctggtggagttcggtgagttttacggcggcgtggtggatctgacgaatccggccgcgtacgactggttcaaaaatatcatcaaacagaacatgatcgcgctgggctgcggcggctggatggccgacttcggcgaatacctgcccaccgacaccgtgctgcataacggcgtcagcgcagagatcatgcataacgcctggcctgcgctgtgggcgaagtgcaactacgaggcgttgcaggagaccggcaagctcggcgagatcctgttctttatgcgcgcgggcggcaccggcagccagaaatattccgtgatgatgtgggccggagatcagaacgtcgactggagtctggacgacgggctggcgtcggtagtgcctgcggcgctgtcgctggcgatgaccggccacgggctgcatcacagcgatatcggcggttacaccaccctgttcgacatgaaacgcactaaagagctgctgctgcgctggtgcgatttcagcgccttcacgccgatgatgcgcacccacgagggcaatcgtcccggcgataactggcagtttgacggcgacgcggaaaccatcgcccacttcgcccgcatgaccaccgtcttcaccaccctgaagccttacatcaaagccgccgtggcgcagaacgcgaaaagcggcctgccggtgatgcgtccgttgttcctgcactacgaagacgacgcccgttgctatgagctgaagtatcagtatctgttcggccgcgatctgctggtcgcgccggtacatgaacaggggcgcgaggactggacgctgtatctgccgccggatgcgtggatcaacctgtggaccggggaaagctgtgccgggggcgatattaccgtggacgcgccattgggcaagccgccggtattttatcgcgccgacagtgagtgggcggcgctgttcagctccttacgcacaatctgaatggcatccagcgaggaacgatcatgagtcagtccagcgatccggcaaccctgaagttgccgttcaaagagaagctcgcctatggcatgggcgatctcggctccaatatcctgctggatattggcacgctctatttactgaagttctatacggatgtgctcggtctgccggggacttacggcggcattatctttttgatcgccaagttctttaccgccttcaccgatatgggcaccggcatcatgctggattcacggcgtaacatcgggccgaagggcaagttccgcccgttcgtactctatgccgcgtttccggtgacgctgctggcgatcgccaactttgtcggcacgccttttgagatcaccggcaagacggtgatggcgacggtgctgtttatgctgtacggcctgttcttcagcatgatgaactgctcctacggcgcgatggtaccggcgatcaccaaaaacccggatgagcgcgcgtcgctggcggcctggcgtcagggtggcgcgacgctcggcctgctgctctgtaccgtaggctttgtgccggtaatgaacctggtggaggataatcagcagctggggtatatcttcgcggcaacgctgttttcggtgttcggcctgctgtttatgtggctgtgctatcgcggcgtgaccgagcgttatgtggacgcgcaaccggcgaacgccgcgcaaaaaccggggctgttgcagtcgttccgcgccatcgccggtaaccgtccgctgtttattttgtgtatcgccaacctgtgcaccctcggcgcctttaacgtcaaactcgccattcaggtctattacacccagtacgtgttaaacgatccgattttgctgtcgtatatgggctttttcagcatgggctgcatcttcttcggcgtgtttttgatgcccggcgcggtcaggcgtttcggcaagaaaaaggtctatatcggcgggctgctgatttgggtggcgggcgatgtgctgaactacttcttcggcggcggttcggtgagctttgtggcgttttcctgcctggcgtttttcggctcggcctttgtgaacagcctgaactgggcgctggtgtccgacaccgtggaatacggcgaatggcgcaccggcgtgcgatcggaagggacggtgtacaccggttttaccttcttccgcaaagtgtcccaggcgctggcgggctttttccccggcctgatgctgacgcaaatcggctatatccctaacgtcgtgcagtcggcagagacgcaggaaggcctgcgccagctgatctttatctggccctgcgcgctggcggtggtgacgattatcgccatgggtctgttctataacctcaacgagaaaatgtatgtgcgtatcgttgccgaaatagaaacccgtaagcggatggcgtaatgcaacagacaatgacgccctgcggggcgtcatgaggaacgattatgacaacccatgatccgttaaccctgaaactgagtctgcgtgaaaaagtcgcctacggaatgggcgacttcggctcaaatttgatgttgtgtatcggcaccctctatttactcaagttttataccgatgagttagggatgccagcgttttacggcgggatcatcttcctggtggcgaagttctttaccgccttcaccgatatgctgaccggcgtactgctggatcagcggcgcaacatcggcgaaaaagggaagttcagaccctttattctgtatgcctctttcccggtggcgctggtcgccagcgcgcagtttatggcgaacgactttaccctgacggtaaaaaccgccattgctaccgggctgtttatgctgttcgggctgtgctacagcctgatgaactgttcatacggcgcgatggtaccggcgatcaccaaaaatccgcaggagcgcgcgcatctggcggcgtggcgtcagggcggcgcgacggtcgggctattgctgtgtaccgtaggctttatgccgatccaggcgctgtttaccggcaggccggcgcttggctatcaggtggcggcgttggtgtttgtcaccggcggtctgttctgtatgtggtggtgctacagcggcgtgaaagagcgctatgtggaggtcacgcccgatcaccataaaccgggcattcttaattcattctgcgcgattttccgtaatccgccgctgctggtgctgtgcatcgccaacctgtgcacgctggcggccttcaatatcaaactcgccattcaggtgtattacacccagtacgtgctgaacgatattcatctgctgtcatggatgggatttttcagtatgggctgcattctggtcggcgtgtttctggtgcccggcgcggttaagcgcttcggcaaaaagcaggtctatcttggcggcctgatgctgtgggcggtgggcgatgtgctgaatttcgtctggggcagcagctcgttgctgtttgtgctcttctcctgcatggcctttttcggcacggcctttgtcaacagcctgaactgggcgctggtgccggatacggtggattacggcgagtggaaaaccggcatccgcgccgaaggatcggtttacaccggttataccttttcgcgcaaaatctccgccgcgctggcaggtttcctgccgggcatcatgctgacgcagatcggttatattcccaatgccatacagagcgccggtacgctgctcggcctgcgacagctgatcttcctctggccctgcgcgctggcgatcgtcgcggcactgacgatgggattgttttataagcttaatgagcaacgcttcgcgatgattattgcggagatcggggcgcgaaaaaagcagggtacgcacgctgtacccttcgcaaaaggggaaactccagcgataaaggtatagaaaggaaataaaaaagccccgtcttcgcaggcggggcttcgttttcagtacgaaatcggcttacgcgtctttcggaccacgcatcgcgcgtttacggtcgttctcggtcaggtgacgtttacggatacggatagaggttggggtaacttctaccagttcgtcgtcatcgatgaactccagcgcctgctccagcgacattttgatcggcggaaccagaaccgtggcttcatcagtaccggaagcacgcatgttggtcagcttcttaccggtcagacagtttactgtcagatcgttagaacggctgtggataccgatgatctggccttcgtacacttctgcaccgtgacccaggaacagcttaccgcgatcctgcaagctgaacagcgcaaacgcgactgctttaccctggccgttggagatcagcacgccgttgttacgctggccgatttcgcccggcttaacatcgtcgtagtggctgaaggtggagtacagcagaccggtaccggaggtcatggtcatgaactcggtacggaagccgatcaggccacgtgccgggatcaggtaatccagacgaatacggcctttgccgtcagggatcatgtctttgacatcgcccttacgctcgcccattgcctgcattaccgcgccctggtgctgttcttcgatgtccagcgtcacgttttcgaacggctcctgcatacggccatcgatcatacggttgataactttcggacgggaaaccgccagctcaaagccttcacgacgcatgttttcgataagtacggacaggtgcagttcaccacgaccggatacacggaacgcgtccgcatcttcggtttcttcaacgcgcagcgccacgttgtgcacaagctctttgttcaggcggtcaaggatctgacgggaggtaacgaatttaccttctttgccacagaacggagaggtgttgacgttaaagaacatggtaacggtcggttcatcaacagacagagccggcagcgcttcgacattctgcggatcgcagatggtgtcggagatgttcagttcgcccagaccagtgatcgcgatgatgtcgcccgcttcagcttcagtggattcgatacgttccagaccgaggtggcccagcactttacccactttaccgttacgcgttttaccttcgctgtcgatgatggtcacttgctggttcggtttcaccttgccgcgtttgatgcggccgatgccgataacaccaacatagttgttgtaatccagctgggagatctgcatctgcagcggaccatcaaggtcaacgttcggcgcaggtacatggtcaacaatcgcctggtacagcggggtcatgtcttccgccatatcagtgtgatcgttaccggcgatgcccatcagtgcagatgcatagatgatagggaaatcgagctgctcgtcagtcgcgtcgaggttaacgaacaggtcgaatacctgatcgacaacccagtccggacgcgcgccaggacggtcaactttattaataacaacaatcggcttcaggccgtgtgcaaacgcttttttggtaacaaagcgagtctgcggcattgggccatccattgcgtcaaccaccagcagcacggagtctaccatggacataacacgttcaacttcaccaccgaagtcggcgtgacccggggtatcaacgatgttgatacggtagtcattccatttaatagcggtgtttttagcgaggatggtaatcccacgctctttctccaaatcgttggagtccatcacgcgttcggtcgtttcagcacgctcgctgaaagtaccggattgctgcaggagcttgtcaaccagggtagttttaccgtggtcaacgtgagcaatgatggcgatgttacgcaaattttcgatcacaactttgcctcaggcattagaaatagcgcgttattgtacacgtattaatcgcagtacagaacaggatcacaaagaacctttacaaacaatacggaaagtaaggctttgtgatcgctttcacggcgcagtaaaggggtgccttaacgaaaattgcaccaatatagtgcttgtggttcacaatcaagcactatactggtgcaatgtttccattctggtgcagcccttttgcactatgacgtgcatgataacgccttttgggggtgtttttaaagttggcacagatttcgctttatatcctgcagagcaacaatgccgtttatgagcagtgttttctgacctcgttaccacgacgacaatgacaaaatccgggagagttaagtatgtccgctgaacacgttttgacgatgctgaatgaacatgaagtgaagtttgtcgatttgcgcttcaccgataccaaaggtaaagaacagcacgtcactatcccgtcccatcaggttaatgccgaattcttcgaagaaggcaaaatgtttgatggctcctcgattggtggctggaaaggtatcaacgaatccgacatggtgttgatgcctgacgcgactaccgctgtcattgacccgttctacgaagaaactacgctgatcatccgctgcgacatcctggaacccggcaccctgcagggctatgaccgtgacccgcgttctatcgcgaaacgcgctgaagagtacctgcgttctactggcatcgccgacaccgtactgttcgggccagaaccagaattcttcctgttcgacgatatccgtttcggcagctccatctccggttctcacgttgctatcgatgatatcgaaggcgcatggaacaccggcaccaaatacgaaggcggtaacaaaggtcaccgtccggcagtaaaaggcggttacttcccggttccaccggtcgattcttcacaggatctgcgttccaccatgtgtctggtgatggaagagatgggtctggttgttgaagctcatcaccacgaagtggcaactgcgggtcagaacgaagtggcaacccgcttcaacaccatgaccaaaaaagccgacgaaattcagatctacaaatatgttgtgcacaacgtggcgcaccgcttcggtaaaaccgcgacctttatgccgaaaccgatgttcggtgataacggttccggtatgcactgccatatgtccctgtccaagaacggcaccaacctgttctctggcgacaaatatgccggtctgtctgagcaggcgctgttctacatcggcggcgtaatcaaacacgctaaagcgatcaacgccctggcgaacccgaccaccaactcttacaagcgtctggtcccgggttacgaagcgccggttatgctggcttactctgcccgtaaccgttctgcctctatccgtattccggtggttgcttctccgaaagcgcgtcgtatcgaagtacgcttcccggatccggcggctaacccgtacctgtgcttcgctgcactgctgatggctggccttgacggtatcaagaacaagatccacccgggcgaagcgatggacaaaaacctgtatgacctgccgccggaagaagccgcagagatcccacaggttgcaggctctctggaagaagcactgaatgcgctggacgcagaccgtgagttcctgacagctggcggcgtattcactgacgacgcgatcgatgcttacatcgctctgcgtaccgaagaaaacgaccgtgtgcgcatgacgccgcacccggttgagtttgaactgtattacagcgtttaattattaagactcggtgaatttcttgtcgcagctgtgttggctgcgacaagacagacgcctgaggttttttgttgccgtggaactttagcccatctcaggatgggcttttttctccacgcccggcatatatttgcgaacaattcaccgacttacacttataatgcactgtattggtgcacactaaggagactgctgaatggcaacaggcgtggtgcccgatgctgggcagatcctcaattctctgatcaacagtattttgctggttgatgatgacctggcaattcactatgcgaacccggcggcgcaacagttgctggcccaaagttcacgcaagctgtttggcacaccgttacccgaactactgagttatttttcgctgaatattggcctgatgcaggaaagtttgcaggccggacaaggctttaccgataacgaagtgacgctggtgatcgatggccgctcacatattctttccctgaccgcgcaacgtctgccggagggcctgatcctgctggagatggcgcccatggataatcagcgtcgcctgagtcaggagcagttacagcacgctcagcagatcgccgcccgcgacctggtgcgtggcctggcccatgaaattaaaaatccgctcggcggtttgcgcggcgcggcgcagttgctcagcaaagcgctgcccgacccggcgctgatggaatacaccaaagtcattattgaacaggctgaccggctgcgaaatctggtggaccgtctgttaggcccgcagcagccgggaatgcacgtcacggaaagtattcataaggtggcggagcgcgtggtgaagctggtatcgatggagctgccggaaaacgtcaccctggtgcgcgattacgatcccagcctgcccgaattaccgcacgatcccgaccagatcgaacaggttttactgaatattgtgcgcaatgctctgcaggcgcttggcccggagggcggcgagattgtgctgcgtacccgcacggccttccagctgacgctgcacggcgtgcgctatcgcctggccgcacgcattgatattgaagataacgggccgggtatcccgtcgcatttgcaggacacgctgttttatccgatggtcagtggtcgcgaaggcggtaccgggcttgggctgtccattgcccgcaatttaatcgatcagcactccggcaaaattgaattcaccagttggccaggacataccgaattctcggtgttcctgcctattcggaagtagaggtatttatgcagcgagggatagtctggatcgttgatgacgatagctccatccgctgggtgctggaacgcgcgctcaccggggctggcttgagttgtacgacctttgaaagtggcaacgaggtgcttgacgcgctgaccaccaaaaccccggatgttctgttgtcggatattcgtatgccagggatggatggcctcgccctgcttaaacagatcaaacaacgacatccaatgcttccggtcatcataatgacggcacactccgatctggatgcggcggtcagcgcctatcagcaaggggcctttgattatctgccgaaaccctttgatattgatgaggccgttgcgctggttgaacgtgcgatcagccattatcaggagcagcagcagccgcgtaacgtgcaggtatttggcccgacgacggatattattggcgaagccccggcgatgcaggatgtgttccgcattattggccgtctgtcgcgctcatccatcagcgtgctgattaacggcgagtccggaaccggtaaagagctggtggcgcatgccctgcatcgccacagcccgcgcgtgaaagcgccgtttatcgcgcttaatatggcggccatccccaaggatttgattgaatctgaactctttggtcatgaaaaaggggcctttaccggggcgaatacgatccgtcaggggcgctttgaacaggccgatggcggcacgttatttctggatgagatcggcgatatgccgctggatgtgcagacccgcttactgcgcgtgctggcggacggacagttttaccgcgtcggcggctttgcgccggtaaaagtggacgtgcgtattattgccgccacgcaccagaatctggagctgcgcgtgcaggagggaaaattccgtgaggatttattccatcgcctgaacgtgatccgcgtgcatctgccgccgctgcgcgaacgccgggaagatattccgcgtctggcgcgccacttcttacaggtcgccgctcgcgaactgggcgtggaagccaagcaactgcacccggaaacggaagcggcgctgacacgtgtggcctggccgggtaacgtgcgccagttagaaaacacctgccgctggctgacggtaatggcggccggtcaggaagtgctgattcaggatctgccgggggagctgttcgaaaccactattccggacagcccgtcgcaaacgctgcccgataactgggcgacgctgctggcgcaatgggccgatcgcgcgctgcgttccggtcatcaaaacctgctttcggaagcgcagccggagatggagcgtacgctgcttaccacggcgttacgccatacgcaggggcataaacaggaagccgcccgcctgctcggctggggccgtaataccctgacgcgcaagctgaaagagctgggaatggaatgattttcgggatgaatgtaaagatggattcatagccgcaaattgctgctattttgagctttactgttccgatgagttgagtatgatcaggcgcgttcacgcgggagagagatcatgctggagtcattaattcattttgtatcgagcggcgcagacgtcgccactgcagccagccagacgccccatacggcaatcgcggctgtcctgtgcgcggcgctggtcgggctgttcagttaaatcgtatcccctcctggcgaggggatacgcttatatgacgcgcgagaactgctgcatccgcgctttctggcgcagataagcatcgaagcacatgcagatgttgcggatcaacagacggccttttggcgtcacctgaatacccttctcatccacctccaccagcccgtctttcgccagcggcgcaagcagttttaaatcctcagcaaaatagtcctggaaatccacattccatgcgcgttcgaccgcggcgtattccaggcggaaattgcagatcagcgctttgatgacatcgcggcggatacagtcgtcgcgggtgagcgcgatgccgcgccacagggcgttgccggtctcatccacctgttgataatagcgtttcagctctttctggttctgcgcgtagctgtcgccaatcatgctgatggccgagacgccaaagccaagcagatcggtatcgccctgggtggtgtaaccctggaagttgcggtgcagcacgccttcacgctgggccacggccagctcgtcatccgggcgggcaaagtgatccataccaataaattgatagcctgaatccatcagcgaggaaatcgtctcctgcagaatatccagtttctgctgcgcggtcggcagatcggcatctttgattttgcgctgggcggcaaagagagacggtagatgcgcgtagttgaacacgctcaggcgatccgggctgagctccgccacgcgtttgagcgtgaaggcaaagctttccggcgtctgcttcggcaggccataaatcagatcgatattggtcgaggtaaagccgatgtcacgcgcgcgtttgatcagcgcaaagataaattcttcatcctgctcacggttcaccaggcgctgaacttctttgttgaagtcctgcacgcccatgctcaggcggttaaagccttcgtggcgcaggtggtcgagcacatcaagttcgatttcccgcggatcaacttcaatcgagatttccgcatccgcattaaaactgaactgcgaacgcaaaatttgcatcaggcggctgatctgggctttattaagataggttggcgtcccgccgccccagtgcagctggctgacctgacggccggcgaacagcggcgcgcggtgcaggatctcctgctccagcgcatcaagatattgatcggctttatgctgctggcgggtgacgattttattgcagccacagaagtagcagagcttgtggcagaacggaatatgcacatacagcgacagcgggcgctccgggtaacgggcaacagcctccagaaactgcggttcgccgtaagattcggcaaactccagcgcggtcgggtatgacgtataacgcggcccggaatagttatatttctggatcagggccagatcccagtcgattaactgcgaagacatgcttactccttccggtaatgccgtcggcgagtccggcggcctggactgatcccctggcgggtcatcagccggttgcgcagccttttttgctgctgcgacaaccgtcgtagtttaacgaataaccacgccagataacatataaccggaagggttattagcaggacgggtaagcccatgcagtaaccgttagttgccacccttaagcaggcgcatcatatcttcttttttgtcttcctcttcttcgtcgtcttcatcgtcgtaagaaagacccagctgctgcatcagctcatcaattctgtccagcttagcatccacccatgcctgatcttcactgctcagggtttcgccatcttcaagacgttccagcagcgcatccaggcgctcatccgtttccagcatatccagttcagcctgcggtgaaagcataggtttctcgctcttaggtttttgctgacgcgctaccggggcggcggttttgctgacgcctaacggtaccggggttttactgccaatacggggatctttctgcttgttctgaccgcgggagccggaggcgctgtcgccgcctgacgcacggctgcccgccgcattgccgctgtgtttcttctggcgcttgcgatcgcgagattcctggttgatttcatcgcgggttttacgacgcgtttttgcggggccattgccacgcggagccgacgaaggtttattcataatgtttggtcttgagccgtttttattcagtatagaattgcggcggaatctagcagaaagcaagcaaagaaaaaaggcgacagagtaaactgtcgccttttttcttgtcccaccacccgaaacgggctgaaccatccgtgtttgcttgcaacctgccctgtctgtcctttagcggtaaaccgtccctgattaaatccctgtccctgtaaaaacgtctccagacgtttatcatcccttaaaatcccggtcttcgcctcctggcgctccagaccccttatccttaagtctgcatcctgtggcgtcctcgcctttgcacactactttacctttttgacgaaaactcacaagtatgtaacacgcgttacgccatgctttaggaaaattccatactggcaggtctttaattaacaataggttagacaaaggtcaccctgcaactattcttaaatgtcccataaaagccgtggctaatgtcttacaaaacgaatggctattttgagccgatggcgagaaaaccagccttttcccggcgttcaggtataatcccccaaagctttatttatggagacgaccgctttgactaaattgaattatcatcagacgcattttgtgatcagtgcgcctgatattcgccacttgcctgccgataccggaattgaagtggcctttgcgggccgttccaacgcaggcaaatcaagcgcgctgaataccctgactaaccagaagagcctggcgcgtacgtccaaaaccccgggacgcacccagcttatcaacctctttgaagttgccgatggcaagcgcctggtcgacttaccgggttatggctacgccgaagtgccggaagagatgaaaatcaaatggcagcgcgcgctgggcgaatacctggaaaaacgccagtgtttgcagggcgtggtcatcctgatggatattcgccatccgttgaaggatcttgatcagcaaatgatcctgtgggccgtggaaagtgatattcaggtgctggtattgctgaccaaagccgacaaactggcgagcggcgcgcgtaaagcgcaggtgaagatggtgcgtgacgcggtactggcctttaacggcgatgtgcaggtagaagccttctcttccctgaaaaagattggcgttgataagctgagtgaaaagctggatacctggtttaacggcgtaccgacggcagaagaaaacgcagaataagaacgggcgcggcaggctgctgcgctgtgttttttaccgctttgcacaataaaaaacgccccagtcattactgactggggcggctaaaatattcagccaaatccgattacgtgaagtaaaaggtctgaaagatagaacatcttacctctgtaccctacgtctttaactctactcttttttcagacggacacaaagtgctttttgtaattttttttcattctttacatagcgaattctaatgattgtcacaaaacgtgcggcgttatgttgcttacttacataaacaccgcgttattcattgaacccttagtgcgcctgatcccagttttcaccgctcccgacttccaccagcaacggcacgtccagcctggtgctgttttccatcagttcatggatctttttagataccgcttcgacgtcatctttatgcacttcgaacaccagttcatcgtgaacctgcataatcatccgcacacgcggtttttccgtttctaaccactggtcaacggcaatcatcgcgcgcttgatgatgtcagctgcggtgccctgcataggggcgttgatcgctgcgcgttccgccccggcacgacgtgcgccgttgctggatttgatgtccggcaaatagaggcgacggccgtcaagcgtttccacgtagccctgctctttagcctgcgcgcgggtacgttccatatattcctgcacgcccgggtagcgctcaaaatagaggtccatatacttttgcgactcgcggcgcgggatattgagctggcgcgacaagccaaaggcgctcatcccgtagatcaacccgaagttaatggctttggcgctgcggcgctgttcattggatacgctttccagcggcatgccgaacacttctgccgccgtggcgcggtgaatatcttttccttccgcaaaggcggacagcaggcctttatcgcgcgacagatgcgccatgatgcgcagttcgatttgcgagtagtccgcagagacaatcacgtaatcttccggcgcgataaacgcctgacggatacgtcgcccttcctcattgcgcaccgggatgttttgcaggttgggatcggtggatgacagtctgcctgtcgcggtcaccgcctgatgataagaggtatgcacgcggccagttttgggattgatcatcagcggcagcttgtcggtgtaggtcgatttcagcttcgacaacccgcgatgctcaagaatgattttcggcagtggataatccagcgccagctcttccagcacctcttcggaggtggacggcgcgccgcccggcgttttcttcagcggtttaatgccctgtttttcgaacaggatggtctgcaactgcttggttgatgccaggttaaacggctcgcctgcgatgtcgtgggcgattttttccagttctgccaggcgcagcgtgatttcgccggagtgcttgtgcagcacggccggatcgattttaacgccgttgcgctcaatgcgtgacagcaccggcaccagcggcatctcgatattgttgaaaatattcagcgggccggcgtgctgttgcagctttggccacattttcagatgcagttgcagtgtgacgtcggcgtcttctgccgcgtaacgacccgcctgctccagatcgatctgattgaaggtcagctggtttttacctttaccggcaatctgctcaaaggtgatggtggtatgtttgagccagcgatcggcaagggtgtccatatcgtgtcgcccgaccacgctgtccagaatgtatgactccagcatggtgtcaaacgcgatgccgcgcagctcaataccgtaattttgcaggatgccgcggtcgaacttcaggttttgcccgaccttcagcactttttcatcttccagcagcggcgtaagcaattccagcgctcgttcacgggaaatctgttcaggcgcatccagatagtcatgggcaacgggaatatagatcgcaacgccaggctccaccgcaaaagagaggcccaccagattggcgctgacgttatccaggctgtcggtttcggtatcaaaagccagcaccggggctttttgcaggcgcgggatccaggtctttaatgtctcttcgtccagaatggtcaggtaattatcagaggagagcacggtcgcgggctcgtcatcttcctccacgacaattgtggcttcaaagggacgggccgcagatttagcggctttcgtctgcaaccatttaccggcttcaagatcgaccgtccagcgtttgaattcatacttccggaacatctccatcagctcgtcaacggccggtgcctttacctcaagcttgtcgcaggtcagctccagctcaacatccgttttgatggtggccagctgataagagaggtaggccacttctttgttttgttccagcttcgccgccatggttttcgccccacggaacgacagaccggcaattttttccggctcggcatagagcgcatccagcccacccagcccctgtagcagcgcctgcgcggttttctcgcccacgccgggtacgcctgggatgttatccgaggaatcgcccatcagggcgaggaagtcgataataagttccggcggtacgccgtatttactgatcacctcttccggaccgagaatggtgttcgacatggtgttgatcagggtgatgcctggcgtgaccagctgcgccatatctttgtcaccggtactgatcagcaccgggcggcccattttttcggcttcacgcgccagggtgccgatcacgtcatcggcttcaacgccagacaccgccattaacggcaggcccatggcttttaccatcgcatgcagcggttcgatttgcgcgcgcagatcgtccggcatcggcggtcggtgagatttgtagtgttcaaataactcgtcgcggaaggtcttgcctttggcatcaaacaccacagcagcatgcgtcggctggtactgaaggatcaggcttctgagcatattcagcacaccgtacatcgcaccggtaggttcaccggcgctgttggtcagcggcgggaacgcatggtaagcgcgataaaggtaagacgagccgtcaacaaggataagtgggttttctgggatctgaaccatgatgtccgtgcctgtttattaaattatggttaaaggatgccacagaccggcgcaaacttcagtttttcgccgaatttgcagtaaaagatttctcgatctccgggatcgctcgcatcttcattctgtggataactttgtgagttatttcgatagcactggataattgtgctttactgacgatcgggattttaaaaatatcctttacattcagataaataaaagcattagaatgatcgttattgcggatcgatgacaatttactccatgtggatataagcgtttggtctgaatgcgcgatcggtaagcaggcgttgaaataggatggggtggacgtgaagcgcagggccagcaggaaaagcacaacgccgatcgatgaccggcgttgtagaaacttatttcagcgaaacgaggtgcttaacggtatcagcatattgctggacaaaaacgtccatattgctggtatccataccctgcgggttaagctgatatttgccgttaacaaacatggccggtacgccctgcagttgcagatcggctgcggctttctcctgctgtgcaaccagcgatttcacgacgaagctgtttaacgccgcatcgtaatcttcacccttaacgccggcatcgacaaacactttacgaatgtcagcaacgttctgcaccgtctgggttttctgtaccgcttcgaacataggggccgtgatcttatcttccacgcccagcgccatcgccactgcccatgcttgtgtcaaatccttgcccagcgggccgaggaattccacatggtatttggtcattttggtgccttccggcagcgttttcttcaccgcgtcagagatgtgccagacgcgttcaaaatcgtagcagtgcgggcagtagaatgagaaaaactcaagaacctgaggttctccggctacaggtttatcaagcgtgatgtactgtttgccgtcggtgaactgcgcagcggaagcgctgaatgccagaatcatacctgccagcgccagccaaatcttcttcatgttaatgctctcctggatgtttgacgttaatacataggtgttaattgcaaaggcggctcgcgaagaaccttaacctgctcaatgaaagtcagggtttgctgatgccagtaatcttccccggtcagccacggaaagtttctgggaaacgccggatcgccccagcgtctgataagccacgccaggtaatagacctgccgcatggcgcgtaacggttcgatgagagccagttcgtccgtattaaactcactgaactcctcataggcttcaatgatcatttccagctgcatgcgctgctcggctttatcgccgttaagcagcatccagagatcctgaatggccgggccgttgcgcgcatcatctaaatcgacaaacagcgggccgtcccgccacaggatattgcctgcgtgacaatcgccatgcagacgcagccgggtaaagcggttataccattgccctgtgacttcgttgatcagagtgtcagtggcgcgcagaaaagcatctttaagcccggacgggatcagcgcggcgttttcaaaaacggcgcggggctcaagcaggtattcattaacgccgatgtcaggacggaaggcgaaacaggttttgcgcccggtctggtgcagacgccccagatagcggccaacccactccatttgatcaaggctgtcggattcaaactgacggccaccgagactgggaaaaacggcgtagtaaaaaccctgatgggtgagcagcgtctgcccgttaaacgaaaggggggcggcgacaggaacctcatcgctcaacaactcttctgcaaactgatgctcttcgcggatctgatccgctgaccagcgttgcggacgataaaatttgaccacatagcggcgacggtcttcatcctggaactgatagacacggttttcataactgttaagcggggtgagaccagaatcaacccggatcccctgcgcaaacagcgcatccatgatggtatccgggtgtagcgtctggaaagtaaaagcgttgtcggtcatcccaagttccggaaattactgcgaatgactcagaatatcattttgtggccatttcggtggcgccgcttacaagcttttactctttaattacgccacgggcgcgcagcagggcggttttaaaatcctcttcgtagtctttctgaatacccgggatcgccgcatctttcgcggagtcacgcattttcaggtgatagatcagaatatcatcagaaaggtctgccagttcgccttcataacctgactcctgcgccagtttctgcaaaaattgcatcaggttaagttccggctctttttgccaggcaggctggaggagttcgatgacttcgttcaggcgtttacatttcatgctcagtgctccttattttgatagagacacgttagcagggtcaaacccacaataaaagaggcgatattagtgtatcagtctggagccatcaccggcgttgtgctggctggcggtaaagccacgcgcatgggtggaaaagataaaggcttactggagcttaacggtcagccattatggcggcacgtcgctgaaaagctggctgcgcaggtggacgcggtggttatcagcgccaacagaaatctggccgtatatcaggcgagcggctatccggttattcaggactctctggccggttttcccggcccgctggcgggcatgctggcggttatgcagcaggtgaacagcgagtggttcctgttttgcccgtgtgatacgcctgcaattcccgtggatctggcggcgcggctgcgggccggtcttaatggcgcgcctgccgcgtgggtgtccgatggcgagcgcgatcatccggctattactttgatgcaccgtcagcttgcacctttcctgacagaatatctggcatccggcgaacgtcgcgttatggtggctttgcgccaggcaggaggaaaggcggtggattgcagcgacattaaatccgcttttattaacgttaatacgccagaggatctggctggcagacaggagcatcaatgatacctttgctggcgattgccgcctggagcggtacgggtaaaacaacgctgcttaaggcgctgatccctgaactctgtgccagagggatacgcccggggatcatcaagcatacgcatcataatatggatgtcgataaacccggtaaggacagctatgaattgcgaaaggcgggcgcagcgcaaacgctggtcgccagccagcaacgctgggcgctgatgactgaaacgccggaggagcctgcgctggatctggcgtatcttgccagccgtatggacagcagtaagcttgatattattctggtggaaggttttaagcatgaaccaacggcaaagattgtgctttttcgcagcgctgccggtcatgatgtgagtgaactggtactggatgaacacacgatagccgttgccagcgatattgccttaaaggtgaacgtgccgacgctggatctgaatgatgttaacgcaatagcagattttataatgcgctggatgaagagctgagaaagttctttttttcattttcagcgcgcaacgcaaaaaggccatccgtgaggatggcctttcgcttgtttgatgcctggcagttccctactctcgcatggggagaccccacactaccatcggcgctacggcgtttcacttctgagttcggcatggggtcaggtgggaccgccgcgctagtgccgccaggcaaat

SEQ ID NO: 6 - DNA, 120030 bp, Enterobacter sp SA187
gcggtcccacctgaccccatgccgaactcagaagtgaaacgccgtagcgccgatggtagtgtggggtctccccatgcgagagtagggaactgccaggcatcaaattaagcagtaaaccggggtgacaaccggtggttgtaaagaaattcggtggagcggtagttcagtcggttagaatacctgcctgtcacgcagggggtcgcgggttcgagtcccgtccgttccgccaccctaattaggggcgtagttcaattggtagagcaccggtctccaaaaccgggtgttgggagttcgagtctctccgcccctgccagaaaattatcctttgcttcggcaaaggattttttttgtctgcaatttatcccatctttgattttttccctgctgacgataaaaacatggcgtccctgcgcatgttttcttactccagtacgttgattttaagcagatccttgatatgactctgcttatcgctgttctgtaaccagatggcatacagcggtcgtgaaagcgtcagactatcagtgacggtatgcagatccgccttgttatttgcccacgacaccggcagccaggtgtatccctcaagcgcggccagttgctgacgggcgatctcagcggagctggtcgttaacagcggaatatcatcgctgttaataagccctgcctcatgctgctgaaaatcaggcccccattccaggcgcagataattcaggctggatttcgtcttacctgccgctgcacagtagagcgcaagcgtgaagtgccccagcaactgactgctgaattcatccatcttgggcgcttctgtggtgatgagcagatccagttgtctttcgtgtaactgtttcaccagcgactgccgttgcgcgatccgcgcttcaaactgcaaattcttctgtgactgatacaggcggcttaaccagccgttgagcatacactcccataacgacgcactggcgccgatggacagctcattgtgacgtgaggtatgcgctacctccttgcgtgccgcctgccacgtactcattaacgtttctgcataaggcaacagcttttccccggctggcgtcagccgtatgttgttgcgatgacgggtgaaaagattcacaccgagctggttctctaactgacggatccgaaaactgaccgccgattgcgtcaagtacagcgcttccgcagcgcgaccaaagtgtcgagtcctgctgacttccaggaaagtttttaacaattccgtatccacagctttctccacaaatttatttgtcgttatgatttaaatgttttgttttacactctgtcaagcgtaactaatactccgcgccataaatagctcggccaaagaattaggagcgtgcaggatggcggaaagctttacgacgacgaatcgttttttcgacaataaatactatccacgtgggttctcgcgtcatggtgacttcaccatcaaagaagcccagttgctggagcgccacggatacgccttcaatgaactggatctcggcaagcgtgagcctgcaactgaagaagaagttcagtttgttgccgtatgccgcggtcagcgcgagccggtaacggaagcagaacgtgtctggagtaaatacatgacacgtattaagcgtcctaagcgtttccatacgctctccggcggtaaaccgcaggttgaaggcacagaagactacactgagtctgaagattaaagaaaaggggcgtaaagccccttttttatttctatcgctaacccagcatcttttgtaaatggataagtaaccggtcaatggcgcgatagcttagcgcttcctgtaaatgccgccgctgaatacttttctgctcctcaagatccgcgagcgtacgcgctacctttaacaggcgctgccatgcccgtaccgacagccccagcagcgtaagcgtctcttccagccagtgcgcatccccggcgctcaactggcaatattcccgcatttcaccactttccaggcggctgttcagcttctgctggcgagcgtactgacgttcacgcgcgctcaccactctggcacgcacgctttcgctgcgttcgccctgaccgcttgcctggctcagcacgccgggcggcggtagcgggatctccagcgacaggtcaaaacgatcaagaaaaggccccgacaatttgcccaaataacgcagcgtctgctccggcgttgagcggttatggttcccctgataatgaccggtcgggctgggattcatcgcagctatgagttgaaagctggcgggataggtcactttggcccgcgtgcgcgaaatatgaatctgaccggattcaaccggctcccgcagtgcatccagtacccggcgctcaaactccggtaattcatcgagaaataaaatgccgttatgagcaagcgagatctcgcccggagcagggatcgtcccgccgcccaccatcgctgttaatgacgcgctgtgatggggggagcggaaaggcctgcgccgccagtgttttttaaggaccgcagcattgaccaggctcagaatagccgcgctttccagggcttcttgattattgagcggcggcaggatcccggtaaggcggctggcgagcatggttttgcctgtaccaggcgggccaatcagcagcaaattatgaccgcccgcagctgtcacttccagcgcacgcttcccctgatcctgaccgatgacgtcgctgagatcgctctctgtcgggaattcgtcattaatggtctgttcaggatggcggagagtagttttcccttccagaaaagcacaaacctccagtaaatgtccggcaaccaggcaatctgatgagccgagtaagctcacttcagcttcgttatcagcagcgacaataatcttcctgcccgctttgatagcctccatcgcggcggaaattgcgccgggaacgccacgcagcgcgcctgtaagcgccagttctcctacaaactcatactggctcagcatagcggtcgtaagctgctcagaagccgccagaagcgcgacagcgataggtaaatcatatcgtccgccttccttgggcagatcggcgggcgcaaggttaatagtgatcttccgtgcggggaactgataaccactgttaatgattgcgctgcgtacccgatcgcgcgcctccttcaccgtggtttccggcagccccaccatcgtcaggccgggaagcccattgctgagatgcacttccaccgtaatcagcggtgccgtcacccctaatgctgcgcgtgtgtagataactgacaatgacatgatccctccttgagaggtgattatgtccggagcaatttgttgcggcacctggcaaaaccgtatcctgcgcggcgcattcagcacatttttattcgttaccgtttttgcactttcacgctggaacgcgcctcgcatatatcgctatgcgagccagaagggaagatgatgacgcgacaaattgaattattctcacatgatgatttcgctatataaaacaatggctttttttaaaatcttcggcaggctgaaaaattagcatataaataaatcttgtcttttacgcgctgtctgtgataactctttaggtattccttcgaacaagaagccagaaagtatataaaatgacagcccttctacgagtgattagcctggtcgtgattagcgtggtggtgattattatcccaccgtgcggggctgcacttggacgaggaaaggcttagaaatcaagccttaacgaactaagacccccgcaccgaaaggtccgggggtttttttatgactttaaaacatccacgaggagcaaagaatgagtagtagcataaaattctgttcctcacgatttacgacggggaagtaactatgaatggagcacagtgggtagtacatgctttgcgggcacaaggagttgaaaccgtcttcggttatccgggtggcgcaattatgccggtttacgatgcattgtatgacggcggcgtggaacacctgttgtgccgtcacgagcagggcgcggcgatggcggccatcggttacgcgcgcgccaccggtaaaaccggcgtctgtatcgccacctccggccctggcgcgactaatctgatcaccggcctcgccgatgccttactcgattccgttcccgttgtcgccatcaccggccaggttgctgccccgtttattggtaccgatgcgtttcaggaagtggatgtgattggcttatcgctggcctgcaccaaacacagctttctggtgcagtcgctggatgagctgccgcgcgtaatggcagaagctttccaggttgccagctcgggtcgccccggcccggtattgatcgacatccccaaagacatccagctggcctccggtcatcttgagccgcatttctctaccgttgaagcagaagaaaccttcccgcaggacgacgtggagcaggcgcggcagatgctggcgcaggcaaaaaaaccaatgctctacgtcggcggtggcgtgggtatggcgcaggcggttcccgcgctgcgtgactttgctacggctactcaaattccggttgcctgcacgctgaaaggcctgggcgcggttgaggcggattatccgtggtatctcggcatgctgggaatgcacggcaccaaagcggcgaacctggcggtgcaggagtgcgatctgctgatcgccgtgggcgcgcgctttgatgatcgcgtgaccggcaagctgaacacctttgccccacacgccagcgtcattcatatggacatcgatccggcggaaatgaacaagctgcgtcaggcgcatgttgccctgcagggggatttaaccgccttgctgaacgccttacagcagcccctgaatatcaccgaatggcgtgagtacaccgctgatctgcgccgcgaacacgcctggcgttacgaccatcctggcgaggcgatttacgcgccgctgctgttaaagcagttgtccgatcgtaagccaaaagagagcgtggtgaccacggatgtaggccagcaccagatgtggtctgcgcaacatatgacctacagccgcccggagaactttattacctccagcgggctgggaaccatgggctttggcctgccggcggcggtcggggcgcaaatcgcccgtccggatgatacggtgatctgtatctccggtgacggctccttcatgatgaatgttcaggagctgggcaccgtaaaacgcaaacagttgccgctgaagattgtcttactcgataaccagcgcttaggcatggttcgccagtggcagcagctgtttttccaggagcgttacagcgaaaccactctgaccgataaccccgatttcctcatgctggcccgcgcctttggcatccccggccagcacatcacccgtaaagaccaggttgaagcggcgatcgacaccctgctcgcaagcgaagggccttatctgcttcatgtctcaatcgacgaactggaaaacgtctggcctctggtgccgcccggcgccagtaactcacaaatgctggagaaattatcatgatgcaacatcaacttgccgtgcaggcccgctttaatccggaaacattagagcgcgttttacgcgtagtgcgtcatcgtggcttccagatttgtgcgatgaacatggaaaccgccgccgatccgcagaacataaatattgaattgaccgttgccagcccgaggtctgtcgaattactgtttagccagctaagcaaactggtggacgtagctcgcgtcgagctccagcaacgtacaacgacatcacaacaaataagcgcctgagcgcaataggaaagaaaatgacgacgaaaaaagctgattacatttggtccaatggcgagatgattcgttgggaggacgcgaaggttcacgtcatgtcccacgcgttgcactacggtacttccgtcttcgaaggcatccgttgctacgactcgcacaaagggccagtggtgttccgccatcgtgaacacatgcagcgtctgcgtgattcagccaaaatttatcgtttcccggtctctcaaagcgttgatgaactgatggaagcctgccgcgcggtgatccgcaaaaacaacctgaccagcgcctatatccgtccgctggtctttgttggcgatgtcggcatgggcgttaacccgccggaagggtacagcaccgatgtgatcatcgcggccttcccgtggggcgcataccttggcgcagaagcgctggagcagggcattgacgcgatggtctcttcctggaaccgcgtagcgccgaacaccatcccgactgcggcaaaagctggtggtaactatctttcttccctgctggtgggcagcgaagcccgtcgtcacggttatcaggaagggatcgcgctggatgtgaacggctatatctccgaaggcgctggcgaaaacctgtttgaagtgaaggatggcattctgtttaccccgccattcacctcttccgcgctgccgggcattacccgcgatgcgatcatcaaactggcgctggatctgggtatcgaagtgcgcgagcaggtgctgtcccgcgaatccctctacctggctgacgaagtgtttatgtccggcaccgccgccgagatcacgccagtacgcagcgtcgacaaaatccaggtgggcgaaggccgtcgcggtccggtcaccacccgtattcagcaagcattctttggcctctttaccggtgaaaccgaagataaatggggctggctggatcaagttaattcataagcataatgacagggcggcacgtaccgccctgaatacctgacagacgggagtaaataaagcatgcctaagtaccgttccgccaccaccacccatggccgtaatatggccggcgcccgcgcattatggcgcgcgaccggcatgaccgacgacgatttcggcaagccgattattgccgtggtcaactcgtttacgcagttcgtgccgggccacgttcatctgcgcgacctgggtaaactggtcgcagagcagattgaggcctcaggcggcgtcgccaaagagttcaataccatcgcggtagatgatggtatcgccatggggcacgggggcatgctttattcactgccatcacgtgaactgatcgccgactccgtggaatatatggtcaacgcccactgcgccgacgccatggtctgtatttccaactgcgacaaaatcacccccggcatgctgatggcggcattacgtctgaacattccggtgatttttgtttccggcggcccgatggaagccggtaaaaccaaactctccaatcagatcatcaaactggatctggtggatgccatgatccagggcgcagacccgaaagtttccgacgagcagagcgagcaggtcgagcgctccgcctgtccgacctgcggctcctgttccggcatgtttaccgccaactccatgaactgcctgaccgaagcgctcggtctgtcgcagccgggtaacggttccctgctggcgacccatgccgatcgcgaacagctgttcctcaacgccggtaaacgcattgttgaactgaccaaacgctattatgagcaggacgatgaaaccgcgctgccgcgcaatatcgccagcaaagccgcgttcgaaaacgccatgacgctggatatcgctatgggcggctctaccaataccgttctgcacctgctggcggcggcgcaggaagcggaaattgacttcaccatgaccgacatcgacaaactgtcgcgtcatgttccgcagctgtgcaaggttgcccccagcacgcagaaatatcatatggaagacgtccaccgtgcaggcggggtgatcggtattctgggcgagctggatcgcgccgggctgatgcagcgcgacgtgaaaaacgtcctcggtctgacgctggcgcaaaccattgagcagtacgacgtgatggtcacccaggacgactcggtgaaagagatgttccgcgccggtccggcaggcatccgcaccaccaaagccttctcgcagaattgccgctgggatacgctggataacgatcgcgccaacggctgcattcgttctattgaacacgcctacagcctggaaggtggcctggcggtgctgtacggcaacttcgcggaaaacggctgtatcgtgaaaaccgcaggggtggacgacagcaacctgacctttaccggcccggccaaagtctacgaaagccaggacgatgcggtagaagctattcttggcggtaaagtggtggcgggtgatgtggtcgtgatccgctacgaagggccgaaaggcgggccgggtatgcaggaaatgctctatccgaccagcttcctgaaatccatgggtctgggcaaagcctgcgcgctgctcaccgatggccgtttctccggcggcacctccggtctttccatcggccacgtctccccggaagcggccagcggcggcaatattgcgctgatcgaagatggcgacatcatcgccattgatattccgaaccgtgggatccagttgcaggtgagcgatcaggaactggcggcccgtcgtgaagcacaggaagcgcgcggtgctgctgcctggacgccaaaagcccgtgagcgtcaggtttctttcgcgctgcgtgcctacgccagcctcgcgaccagtgcagataaaggcgcagtgcgcgataaatcgaaactgggaggctgattatggccgaagcccaaccgctgtctgccgcccctgacggggcggagtatctccgggcggtgctgcgcgcacctgtctatgaagcggcgcaggtcacgccgctgcaaaaaatggaaaagctctcttcgcggctggataacgtcattctggtgaagcgcgaagatcgccagccggtgcacagcttcaagctgcgcggcgcatacgccatgatggccgggctgacggaagcgcaaaaagcgcagggggtgatcacggcctctgcaggaaatcacgctcagggcgtggccttttcgtcttcgcgtctcggtgtgaaagcgctgatcgtgatgcccgtcgccaccgccgacatcaaagtcgacgcggtacgggcgttcggcggcgaagtgttgctgcacggcgcgaattttgacgaggcgaaagcccgggctatcgaactgtcacagcagcagggttttacctgggtgccgccgtttgatcacccgatggtcatcgccggtcagggcacgctggcgctggagctgctacagcaggacgcgcatatcgaccgcgtctttgtgccggtcggcggcggcgggctggcggcgggtgtggcggtgctgatcaaacaactgatgccgcaaatcaaagtgattgccgttgaagcggaagattccgcgtgcctgaaagccgcgctggacgccgggcatccggttgatttaccgcgcgtcgggttgttcgccgaaggcgtggccgtcaaacgtatcggcgatgaaaccttccgcctgtgtcaggaatatctggatgacatcatcaccgtcgacagcgatgccatttgcgcggcgatgaaagatctgttcgaagatgtacgtgcggtggcagagccgtccggcgcgctggcgctggcggggatgaaaaaatacatcgcgcagcaccatattcgcggtgaacgtctggcgcatgtgctgtccggcgcgaacgtcaatttccacggtttgcgttacgtttccgaacgttgcgagctgggggaacagcgtgaagccctgctggcggtgaccatcccggaaaccaagggcagcttcctgaaattctgccagctgctgggcggacgtgcggtaacggagttcaactaccggtttgccgatgccaaagatgcctgtatttttgtcggcgtgcgcttaagccgtgggctggaggagcgcaaagaaattctcgcgctgctgaatgacggcggttacagcgtggtggatctgtctgacgatgagatggcgaaactgcacgtgcgctatatggtcggcggtcgcccgtcgaaaccgcttaaggaacggctttacagctttgagttcccggaatcccccggcgcgctgctgaaattcctgcacacgctggggacgtactggaacatctcgctgttccactaccgcagccacggcaccgactatggccgcgtgctggcggcctttgagctgggcgagcatgaacccgatttcgaaacgcgcctgaacgaactgggttacgagtgtcacgacgaaacccacaacccggcgtttcggtttttcctcgcgggctaatgtgtcgaggtgcctgatggcgctgcgcttatcaggcctacaggggtgtaaaacggtaaatcgcagaaaacgtaggccggataaggcccttgcgccgccatccggcgaaacccacgcgccagacagtaaatcgcaggccggataaggtgcccgcgccgccatccggcaaaatctatgcgcccggcaaaatagaccagaacgcattcaccagcggctcatgcagccgctttttttgtgcgcacacgcccagctcgaacggcgttctctcatcgctgcgctccaggatcatcacgcggttacgcaccggctccgggctgttttccagcaccacctccgggatcagcgccacgccgcagcccagcgccaccatcgataccatcgcctcatgcccgcccaccgtggcgtaaatcgacggattactgattttttgccgacggaaccacagttcaatacgacgacgcaccggtccctgatcgggcatgataaaaggcaccgtcgaccagtccggctcggcaacggacacctgattgcgcaccgggcagggcagcgccggggcgatcagcaccaccgccagattttccagcattgaaaaggccaccgcgccgggcagcgtttccggtttgcccgcaatcgccagatccgcctcgccggtgaccactttgtccatcgcgtcggcggcatcgccggtggtcagcttgatttccacggacgggtgttcggcgcgaaaacggtcgaggatcggcggcagatggctgtaggccgccgttaccgaacaaaacagcttaagctcgccggacagcgatggcccctgctgatcgatggtgtggcgcaactgctgatactgcaacagcgtatgctgcgcgaaggtacgcagctcttcccccgcttcggtcagcgtcacggtgcggttatcgcgcacaaacagcggctgccccaggtcttcctccagacgctggatctgccgggaaagggtggaaggactgacgtgcatggcgcgcgcgctgcggccaaaatgacggctttccgccagatgcaggaagattttcagatcgcgtaaatccatcgggtcagctccagatttttacgttgcgaattatgcaacgtgacgttgttaatatatcaatttcagcaacgcatttcctgtcatatagtgggttcattctcgcaataacgcgaaccgaataataagtacgacacaacatcacgaggatcgaccatggctaactacttcaatacactgaacctgcgccagcagctggcgcaactgggcaaatgtcgctttatgggccgcgatgaattcgctgacggcgcaagcttcctccagggtaaaaaagtggtcatcgtcggttgtggcgcgcagggtctgaaccagggcctgaacatgcgtgactccggtctggatatctcctacgcgctgcgtgccgaagccattgctgaaaaacgcgcctcgtggcgtaaagcgaccgaaaacggctttaaagtcggtacttacgaagagctgataccgcaggcggatctggtggttaacctgacgccggacaaacagcactccgacgtggtgcgttccgtacagccgctgatgaaagacggcgctgcgctgggctattcccacggcttcaacatcgtggaagtgggcgagcagatccgtaaagacattaccgtggtgatggtggcgccgaaatgtccgggtacggaagtgcgcgaagagtacaaacgtggtttcggcgtaccgacgctgatcgccgtgcacccggaaaacgatccgaaaggcgaaggcatggcgattgctaaagcctgggccgcagcaaccggcggtcaccgtgcgggcgtgctggaatcctctttcgtggcggaagtgaaatctgacctgatgggcgagcagaccattctgtgcggtatgttgcaggctggctctctgctgtgctttgacaagctggtggaagagggcaccgacccggcatacgcagaaaaactgatccagttcggctgggaaaccatcaccgaagcactgaagcagggcggtatcaccctgatgatggatcgcctgtccaacccggcgaaagtgcgtgcgtatgcgctgtctgaacagctgaaaaccattatggcgccgctgttcaaaaaacatatggatgacatcatctccggtgaattctcctccggcatgatggctgactgggccgaagacgataagaaactgctgacctggcgcgaagagaccggtaaaaccgcctttgaaactgcgccgcagtttgaaggcaaaatcgccgagcaggaatacttcgacaaaggcgtgctgatgatcgcgatggtgaaagcgggcgttgagctggcgttcgaaaccatggtggattccggcatcatcgaagaatccgcgtactacgaatcgctgcacgagctgccgctgatcgctaacaccatcgcccgtaagcgtctgtatgaaatgaacgtggtgatctccgataccgccgagtacggtaactacctgttctcttatgcctgcgtgccgctgctgaaagagtttatgaccacgctgcaaccgggcgatctgggcaaggcgattgaagggactgcggtggataacgcccagttacgcgacgtgaacgaagcgatccgcagccacgccattgaggcggtcggtaagaaactgcgcggttatatgacggatatgaagcgtattgccgtcgccggttaataacaccctatagcgttactgtaggcccggtaagcgccagcgccaccgggctttattaagcactaaatgtaggcccggtaagcgtcagcgccaccgggctttttatcagttgcggtacagcactttaatgatgtggtagccgaactgggtgtgcagcgggccggttggctccagcaccgggcaggagaacaccactttatcgaaggccggaaccatctggccctgacggaattcacctaaatgaccgccttttttacctgacgggcaggtagagtgttttttcgccagcttctcgaaatcgccgccgtttttgatctgttccagaagatctaacgccagtttctcttctttaacaaggatatgcattgctgccgctgtttttgccatgatcgtgccttgagtcagatagtttacgctcgctatactaccacgcgtttttatcccctcctgcctttcattgagtgattttcttatgcgtttgaaccccggacaacaacaagccgtcgaatttgtcaccggaccctgtctggtgctggcgggggccggctccggcaaaacccgtgtgatcaccaataagatcgcgcacctgatccgtggctgcggttatcaggcgcgacacatcgcggcggtaacctttaccaataaagccgcgcgggaaatgaaagagcgtgtcgggcagacgctgggacgtaaagaggcgcgcggcctgatgatctccaccttccatacgctggggctggatatcatcaagcgggaattcgcggcgctcggcatgaagtccaacttttccctgtttgacgacaccgaccaggtggcgctgctcaaagatctgaccgaggggctgatcgatgacgataaagtggtgctgcaacagctgatctcgacgatctctaactggaaaaacgatctttgcacgcccgcgcaggcagcggctcaggcgaaaggcgagcgggatcgtatcttcgcccactgctacggcctgtacgacgcgcacatgaaagcctgtaacgtgctcgattttgacgatctgatcctgctgccgacgctgctgctgcagcgcaatgaagaggttcgcgagcgctggcagaacaagatccgctatctgctggtggatgaatatcaggacaccaacaccagccagtacgagctggtaaaactactggtaggcagccgcgcgcgctttaccgtggtgggggatgatgaccagtcgatctactcctggcgcggggcgcggccgcaaaacctggtgctgttaagccaggatttccccgctttacaggtgatcaagctggagcagaattaccgctcatccggacgcattctgaaagcggcgaacatccttatcgccaataacccgcacgtgtttgaaaagcggctgttctccgaactgggctacggcaccgagctgaaagtgctgacggccaataatgaagatcacgaagcggagcgcgtcaccggcgagctgattgcacatcacttcatccagaaaacgcagtacaaagattacgccattctctatcgcggtaatcatcagtcccgcgtgttcgaaaaattccttatgcagaaccgcattccgtaccgcatctccggcggcacgtcgtttttctcacgtccggaaatcaaagatctgctcgcttatctgcgcgtgctgaccaataccgacgacgacagcgctttcctgcgcattgtgaacacgccgaagcgggaaattggctctgctaccctccagaagctgggcgagtgggccaacacgcgcaacaaaagcctgttcgccgccagcttcgacatgggcctgacccagacgctgaccgggcgcgggtatgaatcgctgacccgctttacccactggctgggtgaagtgcagcgcctgtccgagcgcgatcccatcgcggcggtgcgcgatctgatccacggcatcaactatgaatcctggctgtatgaaacctcacccagcccgaaagccgctgaaatgcgcatgaaaaacgtcaacacgctgttcagctggatgacggaaatgctcgaaggtagcgatattgatgagccgatgaccctgacgcaggtggtgacgcgctttaccctgcgcgacatgatggagcgcggcgaaagcgatgaagagtccgaccaggtgcagctgatgacgctgcacgcctcgaaaggtctggagtttccgtacgtgtttatggtgggaatggaagaaggcttcctgccgcaccagagcagcattgatgaagacaatatcgaagaagagcgccgcctggcctatgttggcatcacccgcgcgcaaaaggagctgaccttcacgctgtgcaaagagcgtcgtcagtacggcgaactggtgcgcccggagccgagccgttttctgctcgaactgccgcaggacgatgtgatctgggagcaggagcgcaaagtggtcagcgccgaagagcggatgcacaaaggccaggcgaacctggccagtatcaaagcgatgctggcaaaatcgaaagcgaaataatccctccgcctgtgcagagggatcaatcacacggttactgctgccccgcccacaccaccatcactttatcgtcgcccgcttcacgggtaaaaccatagccctgcggcatggaaagcgtggtttgcttacccatgccgatagccggatggcgggcgcggaactgccccagccgctgccagtgggcgacacgcggcgcagcgctgccggtcacatcctgccagttcatatccgaacgcgtgccctggagcggatccgagccggtgggtccgaacggtcgtccggactcgtcgccgtaaaaaatctgcaccgcgccgggcgtcagcaacagcagttcagccgcccgctgatccgcttcgcggaacagccgcgtatcgtgggatgacaaataactcagcacgttaaaacgctgtagcttgtcggccatctgctgccacgtcagatcgatgctggcgaagcaatccgccgctttcgccgcctgctcctgataatcaaaattgatcatcgcatcgaatccatgacggtaatagctgctctccatgacgccgtggccccaggcttcgccggtcatccagaaaggcgcgtcatcgcgttttttctgcgggttggcctgcttccactctgccagcgcttgagtcgcctgggttttcaactgctgtaaggtggccatatccacatgcttggcggtatcgacacggaaaccgtcaatgccgtactcccgcacccagtcgctcagccagcgggtgaggtaatcacgcggcgtgaagccgtcgatagctttcgcgcgggtatccggcttgtgctgataaaacactggcagtccggagggagtggtcgactcggttttcagatccggtaaaaacgccagcgacatggtgagatcgtcgaagccgggattatcgtaatcgccaatatcggtgcgcacccaggctttgccccaccagttttgccaggcgtttttatcgctgaagttgatgtaatcattaaagctgtgccagttctgtccggcggcgggcttccagtctgtccagcgctcgccgagcacttttttacgctcctcgccctgcacatagagcgcgccgaactgatactgctgcatatcggccagggtcgcgtaaccggtatggtttaccaccacgtcaaacaggatgcggatgccgcgctggtgcgcttcatccaccagcgtgcgcagatccgcttcgctgcccatgttggcatcaagcatcgtccagtcctggatgtaatagccatgataggcgtaatgcgggaaatcgcctttggtgccgccgcccacccagccgtggatctgctcgaagggcgcgctgatccacagcgcattgacgccgagctgcgagaggtaatccagcttttgcgtcagccctttcagatcgccgccatgaaaagtgccgatctcttccatgccgtctttgtggcggccatagctgttgtcattggccggatcgccgtttacgaaacgatcggtcagcacaaaatagacggtggcgttatgccagtcgaagggcgcggtggcgtcggtttccgcgcgctcaagcagcagcagaccgtcactgttcgcatcgggcagcagggtgatttttccctgtttgaccgtggcggtttgctgactgtagaaatcgcgcaccacgctgccttcggcaaaggttttactgacgtccagggtaaggggtttgccgtcccatttcggacactggcgcgttaccgctgcggcgctggtctgcggcgcgctcttcaccgtcagcatcaatgttggcgtaccggaacgggtatccagttgcagctgataatcgccatcgcggaacacacgccactgcggcggcgtaccggaacagggctgcaaagagagcatttggttgagtcttggcgtatcgactggctgccagcactgttgatcaagcttcagggttaacggataagcgccttttttcagcggcgcgtcgctgcgataaacccccgatccggcatcgctaaaggcggggaaaccgggggatgtccagtctgaccaggccaccgtgggcagcagcaataataggagggctgaacgtttcattcggggttcctgtcggatgatttttgcccagtgtgccagaagaggctggcgggtaactcatcccgatgagcgcttacgcaggggtgaggcgaaagggtgagtgatctgcttcaaaaaacggcaacaatttgcgataaacgctgcatttcgtgcataatttatacgctgaaacggattagctgatgacacgcattcggaaatcgcttattcattgtgtgtcaataaaagggtatttttgatatgatttgagattccgctctcaaaattgtgaatcaaataaggtgttggaatgcaacaatccgacctggagacctgatgataacgactcccatacgacgatatggggtaacgattctaatgtttctcaccctggtattttccggtgaggtgcttgccaagacgcacgaaaaaacagcgagtcataaaaccccgataaccaaacagataagtaagaagcaggctagcagtaaacaagagtattctcgcaatagtgcaaagagtagttcacttcctgatttgcgaaaatacccttccgggacaccaagaaaaaaagcgtttctccggacggtcatgccttatattacgagtcaaaacgcaacgatcgccgctgaacgtaactggttgatgtcaaaacagtacgaaagccagtggtcgtcggccgagcgcgcgcgcctgaaggatattgccaaacgctataaagtgaactggtcgggcaatacccgccgtattccgtggaatacgctgctggatcgcgtcgacatcattccggacagcatggtggcgaccatggccgcagcagaaagcggctggggaacctctaagctggcgcgtagcaacaataacctgttcggcatgaagtgcatgaaaggtcactgtacgaacgcgcccggcaaggtgaaaggctactcccagtttgcttcggtgaaagagtcagtgaacgcctacgtggttaacctgaatacgcacccggcgtataagtcgttccgtaagtcccgcgcgcagctgcgcaaagcggaccaggaagtgacggcgagcaatatgatccataagctcaaaggctattccacgcagggcaagcgctacaacaactatctgtttgccatgtatcaggacaatcagcgactgattgccgcccacatgtaaacgaaaacgccttccagccggaaggcgttttttttcgtcaggcaataacggctacatcatcacttcactgtaccggtcccggtaatctttcggcgtggtgtcgtactccttcctgaataccgaatagaaatactgcaacgacggataaccgcacatctgtgagatctcgttaatggacagcgaggtggaaatcagcaggctgcgggctttctccagtttttcagcgtggatcaccgcgtgaatggtttcaccgacttcctctttaaagcgcttttccagattcgatcgggaaatgccgaccgcgtccaacacctgatccaccttgatccctttgcaggcgtgattgcggatatagtgcatggcctggatcaccgcgggatcgctcagcgatcggtaatccgtcgaacgccgctccaccacgcgcaccggcggcaccagcaatcgctgtaacggcaatggctcattatccagcagacggtgcagtagtttcgctgcctgatagcccatttgccgtgttccctgcgccactgacgagagtgccacgcgcgacagataacgcgtcagctcttcgttatcaataccgatcacgcacagtttttccggcacaggaatatgcagatgctcgcacacctgcaagacatggcgggcgcgcgcgtcggtgacggcgataatgccggtctgcggcggcagggtttgcagccagtcggccagtcggttttgcgcgtgctgccagttctccggcgcggtttccagcccctgatacaccacgccgcgatatttctcctgcgccaccagctggcagaacgcatactcccgctccaccgcccagcgcttgccgctggaggcgggcaggccgtaaaaggcgaaacgctgtacgcctttctcttttaaatgcaaaaaggcgctttcaaccagcgcatgattatcggtggcgatgtaatgcaccggcggatagttatccgcccgatggtacgaaccgcccacgccgacgatgggcacattaaccccggccagcaaccgctggatctcgtcgtcatcgtagtcagcgataacgccatcccccagccattcgcggatattgtcgatacgggtgcgaaaatcttcctcaataaaaatatcccactcggactgcgacgcctgcaaatattcacccacgccttcgacaacctggcggtcataggctttattggcattgaataacaacgtaatgcggtggcgcttttcaaacatgttggtctcttattcagtagaacactacgtctgcttaccacattcagcacactgccggaaaaatttcctccggcagtgtgatcatccctgagatttcattaccttatgcgcgacgtttggtggcggaatccatccataccgccagcaacaaaatcgcccctttcacgatgtactgccagaacgtcggcacgtccatcatgctcataccattatccagtgacgccataatgaacgcccccatcaccgcacccgccacgctgccaataccgccagccaggctggtgccgccgatcacacaggcagcgatggcatcaagctctgcgatgttgcccgctgaaggcgaaccggcccccagtcgtgaactcaggatcaaaccggcgatagccaccatcaggccgttgatggcgaacaccgccagcttagtgcgctccacgttaataccggaaaggcgcgccgcctcgatgttgccgccgatggcatagatgcggcggccaaaggcggtgcgtgtcgccataaacattccggcgagcagcaggaaggtgaggatcagcaccggcgtcggcacgccacggtaatcgttcagcagccagatggcccccagcacgatcactgcaatcagcgcctggcggcccacgactgaagacgacgcgccagcgctaagtcccagcgcctggcggcgcatccgtccgcgccactgccatagcgtgaaagcaaccagccccagcgcgccgacgccaaagccgacgacgtccggcagatagctttgaccaatctgcgacatggcagcgctggtgggcgacacggtggtaccgttggtgatgccgatcagcacgccgcgaaaggcgagcatcccggcgagggtgacgataaacgacggcactttacggtacgccacccaccagccgttccaggtaccgagcagcaggcccagcaccagcgttaccacaatggtcagcggcagcggccagcccagccagacgtcgaaaatggccgccacgccgcccagcagccccatcatcgagccgaccgagagatcgatctccgcggaaataatcacaaacaccatgcccaccgccagaatgccggtgatcgccgtctggcgcagcaggttggagacattacgcgcgctcaggtacgagccgtcggtcatccaggtgaaaaacagcatgatcaccactatcgcggcaatcatcacgaatacctgcaaattcagtgatttcagtccgccgaaggtaacaggctgcggcgcggacaccttgagttcagatgggttggttttcgacatgatgttcgctcctcagcgccgcttccataacctgttcctgggtcagatgatgattgatgagattggccttaagcctgccttcgtgcatgaccagcacccgatcgctgaggcccagcacttccggaagctccgatgaaatgacaatgacggcgatgccctgttgcacaagctgattgataagtttgtagatctcgtatttcgcgccaatatcaatgccgcgcgtgggttcatcgaggatcaaaatgcgcgggttgagcagcagacagcgcgccagaatcgccttctgctgattgccgccgctcaggcggccaatcgccagctccggcgaggaggttttcaccttcagccgtgccagtgactgcaaaatacattgctgctcggcggcatcgtcgaggctggtgagcgggccggaaaactgatccagcgcggcgagggtgatatttttacccaccgccatcaccggcacgatgccgtcttttttgcggtcttccggcaccatcgcaatgccgtggcgaatggcttcctgacagttacggatctgcaccggctgaccatcaataaatacccgtccttcatgacgccccggccagacgccaaacaggcactggaccgcttcggtacgcccggcgccgaccagcccggcgatgcctaaaatctcgccgcgcttaagggaaaaggagacgtcgttgacgcgcttaatatgccggttgaccggatgccaggcggtcagatgctcgacgcgcaggatctcgtcgccggtagtatggggttcattcgggtaaagggcggtcagttcgcgaccgaccatcatggtgataatgtcatcctcactcattccggcagcctcgcgggtgccgatatgctgcccgtcgcggatcacgcagataacgtctgaaatggctttcacttcattcagcttgtgcgagatatagatgcaggcgatgccgtggtgttgcagatcgcgaataatatcaagcagcaccgcggtttcctgctccgtcagcgaggcagtaggctcgtcgaggatcaacaggcgcacctgcttgttcagcgccttggcgatctccaccagttgctgctgcccgagacccaggtcgcccacacgggtatcgggagaaatggcgaggctgacctgcgccagtaatttctggcagcgcagcgtcatagtgtcgtaatccatcaccccgtgatgggtgatttcggcaccgaggaagatattttccagcacggtgaggtgtttcaccagcgccagttcctgatgaataatggcgatgcctttgcgctctgtatcgcgaatatggctggcctcgatcgtttcgcccgcaaaaacgatgtcgccgtcatagctgccaaagggataaatcccgcacagcactttcatcagggtggatttaccggaaccattctcgccgcacagggacaatacttctccggcgttcagttgcaggctgacattatccacggctttcactgcgccaaaggccttggtaatgtttttcatctcaagtaaataaggcatacccgctccgcataaggccaaggataacagtatttgaaacgcttccccgtaccggacggggaagcgcacaaagattacagctggctcttttgatggaatccgtctttgatgacagtggcgtcgatattgtctttattcacttcgattggcgtcagcaggcgggcgggcacatctttcagtccgttgttcagcgtggcatcagccttaggcgttttgccgttacccagttcgacagcgatctccgcagcggtgttcgccagttgggtgatcggcttatagacggtcatcgtctggctgccgttgataatgcgtttgaccccggcgagatccgcatcctggcctgaaatcgccactttacccgccagaccctgcgcactcagcgcctggatcgcgccgcccgccgtggcgtcgttcgaggcgactaccgcatcaattttgttattgttggcggtcagcgcgttttccatgattttgagcgcgttttccggcagccagccgtcagcccactgatcgccgacaattttaatttttccgctgtcgatatagggttttaatactttcatctgaccggcgcggaagagcttggcgttattatccaccggtgagccgcccatcaggaaataattgccctggggcactttttctaccaggctttgcgcctgaagttcgccgactttttcattatcaaaggaaatatagaaatcgatgtcagcattattaatcatgcgatcgtaggctaatacttttatgccttcctgcttcgcttcttttacgacgttacttaatacctgaccgttgtaaggaataataaccagcacatcaacgccgcggttgatcatattttcaatctgcgacatctgggtttcttcgttgccattcgcagactgcacaaatacttcggcacctaaggattcggcttttttaacaaaaatatcgcgatctttctgccagcgctccagacgcaggtcatcaatggccataccgattttaatctctttcgcctgcccggcaaaggtggcgagcagcagggaagcgcagactgtaaggcaaaggttctttatcttcataatagtaatacctttttgtagggttatagggcctgagataaaagaaacatgcaggatccagacgcagcaaattcttaacgcggaatcaaaacctggcaattactgatttttatcctggcgttacgatatttggtttatttgctaatttatgaccgcgatctgattttaatcttcccgggtattagattttgcagaaaattggaaggcgcgccgcaaggtaacctgtagacatttattttgggagccagcgcacgtttgtgcattatctcaatagcagtgtgaaataacgtaattgagccaggcgctgagaggatccagtattaacgcagcaacgaacactcgccgcatacattgattatggagctgattatgcaagcctatttcgaccaacttgaacgtgtacgctacgaaggtacccaatccaccaatccgttagccttccgccactacaatccggacgagctggttctgggcaagcgcatggaagatcatctgcgtttcgccgcctgttactggcacaccttctgctggaacggctctgatatgtttggcgtgggagcctttgaacgcccctggcagcaggcgggcgatgcgcttgagctggcaaaacgtaaagccgatgtggcctttgagtttttccacaaactgaatgtgccttactactgcttccatgatgtcgacgtctcgccggaaggcgcatcgctgaaagagtatctgaacaattttgcgaaaatgaccgacgtgctggcgcaaaaacagcaggagagcggcgtgaagctgctgtggggcacggcaaactgctttactaatcctcgctacggcgcgggcgcggccaccaacccggatccggaagtgttcagctgggcggccacgcaggtggtgacggcaatgaacgctacccatcaactgggcggtgaaaactatgtgctgtggggtggtcgcgaaggctacgaaaccctgctgaataccgatctgcgccaggagcgcgagcaaattggccgcttcatgcagatggtggtggagcacaaacacaaaatcggcttccagggcactctgctgattgagccaaaaccgcaggagccaaccaagcaccagtacgattacgacgtcgccacggtctacggcttcctcaagcagttcggtctggaaaaagagatcaaagtgaatatcgaagccaaccacgccactctggcggggcacaccttccaccacgagatcgcctccgccatcgcgctgggcatctttggctctgtggatgctaaccgtggcgatccacagctgggctgggataccgaccagttcccgaacagcgttgaagagaacgcgctggtgatgtatgaaatcgtcaaagcgggcggttttaccaccggtggtctgaactttgacgccaaaatccgccgccagagcaccgacaaatacgatctgttctacggtcatattggcgcgatggacaccatggcgctggcgctgaaagtggcggcgcgcatgattgaaagcggcgaactggataagcgcgtggcgaagcgttacgcaggctggaacggtgagctgggtcaacagatcctgaaaggacagctgtcgctggcggaactggcgaagcacgctgagcaacaaaacctggcgccgcagcaccagagcggccatcaggaactgctggaaaatctcgttaaccgttatctgtttggttagcaaaccctgagcgccacgtccgtcgtggcgctccgatcacagcctgtacaggagcagtcattatgtacatcggtatcgacctcggcacctcgggcgtaaaagcgatcctgctgggcgagcagggtaacgtgcttgcctcttacaccgagtcgctgacggtttcacgcccgcatccactctggtccgagcaggatcccgaacagtggtggctggcgacggatcgcgcaatcaaaggcctcggcgcacagcatccgctggcccaggtaaaagccgtggggatcgccgggcagatgcacggcgccaccctgcttgataaacaggacgttatcctgcgtccggcgattttatggaacgatggccgctgcggtgaagagtgcgcgctgcttgaagcccaggtgccggactcgcgcgccattaccggcaatctgatgatgcccggttttaccgcgccaaaactgctgtgggtgaagcgtcacgaaccggacgtgttcgcccgcgtggcgaaagtattactgcctaaagattacctgcgtctgcgcatgaccggcgagtacgccagcgatatgtccgatgcggcaggcaccctgtggctggacgtcgcgaagcgtgactggagcgataccctgctggcagcctgcggactgacccgcgaccagatgcccgcgctgtttgaaggcagcgccattaccggcagtctgttgcctgaggtggcgcaggcctggggattacccgccgtgccggtggtggctggcggaggcgataacgccgccggtgccgtgggcgttggcatgatcgatgcgggccaggcgatgctctccctcggcacctccggcgtctattttgccgtcagcgatggctttctgagtaaaccggaaagcgccgtgcacagtttctgccacgcgctgccggaacgctggcatttaatgtccgtgatgctgagcgccgcctcctgtctcgactgggcggcgaagctgaccggcctgtcctcggtggcggaactgattaacgccgcgcagcaggcggataagaacgccggtgacctctggtttctgccgtatctctccggcgagcgcacgccgcataacaacccgcaggcgaaaggcgtcttttttggtctgacccatcagcacgggcagaacgaactggcgcgcgctgtgctggaaggcgtcggctacgcgctggcggacggcatggatgtggtgcatgcctgtggcatcacgccgcaaagcgtcacgctgattggcggcggagcgcgcagcccttactggcggcagatgctggcggatatcagcggtcagcagctggattaccgcaccggcggcgatgtcggtccggcgctcggcgcggcaaggctggcgcagatcgcccttaacccggatcgggcgctgtccgatctgctgccgccgttgccgctggagcaggcgcatctgccggatgccgcgcgccacgcgcattacgcaccgcgccgggaaaccttccgccgcatctaccagcagcttctgccgttgatgtcgtgaaagcaggccgtccgcgaacggcctgatgatgtccttttctggtattagcaaacgcaggacgccttgtcagaatggcagtacacccactgcacaaggcgtcctgaaatgacccgtaccgcgcttatcaatatcgatacccaacaatccttcccgcaaaaagatttctggcaggaggaggagtagttgcctgcatttcaggaggcaatgctccgtctggtggcggcggatctgggctaccgcgtgacctttgtcagcgaagcgacgttaaccttcccgatgacgcataatggcattacgctggacagcgcaacgctgcgtcaccgcacggaaaccgtgctggtggatcgctttgccgccattaaaaccgtaacccaaacgctggagtcgcttgcatgagtgtggatgtctggttcgtgatgctgccgggggtgctggcgctggatatgaccggcccggcagaaacctttgcgctggcgggcaatgcgttccgcctgcatttcatcgggccggacgccgaggtgccgacctctgtcggcgtgaccatgggcaatatcgcgccgctgcccgacacgctgccggatggcagtctgctggtgcttcccggcgtgtcagactcctcacgctatttcgccacaccgcaggccgaccgtgtttgtcactggttgatgcgccagcagccgctgatccacagccagaacatcaccctgatgtgcgtctgttccggctccctgctggcggcgaaagccgggctgatgcaggggatcacctgcaccacacaccacgatgtgatcgcccggctgaaggccgccgcgccgacggcgcaggtgaaagagaaccgcatttttattgaagatcgcggcatctggaccagcgccggtatcacctcggggattgatttaaccctgcacctgattaaccgcctgtgcgggccggaaacggcgctggccgtggcgcgggagatggtggtgtggtttcgccgctcgggggacgatccacagctgtcgccctggttgcgctatcgtaatcatctgcatccggcgatccaccgggcgcaggatgcgttaacgaatgcacctgaaaaagcctggtcgctggtggacattgccgcctgtgcgcacgtcagcccgcgtcacctgacgcggctgttccagcaacatctgggcatcagcgtgcgcgactacctggaacagctgcggctggcggtggcggagcagtggctggtgcaggggcgcggtgtcgaacacgcgtcgcaggccgcgggattttcctctccgcggcagctgcaccgcgcccgccagcgggccatcagctgacaaagcgacggctatcgaggcgctgcaacagcatcgacagcgctaaactgcataccagcgcggcggcgaagatccacagcatatccagcagcggcgagctttttatctccaccccgcgcgtgcgtaacgcatgaataatcagcgcgtgaaagccgtaaatgcctaatgaatgccgcgagatcagccccagacccggcagaacgcgggtattgagcgtgtttttcaccagcgtaagcaggctgatggcgcagataaacaccatcgggccgcaatagtgataccaggtatcggcgaaattaccgcgccagcgcagttcatgcagcgtgccgcgcgaaatgacaaacactgcggcaataaacagcgccgcgcacagcccgctcacatatttgcgctgcgtatccatcatgccgagggcgcgcccgagaatgccgtacagcacgtagtaaaaggtatcgccgttgatgtacagattcaccggcagccattccacgccgccggttttcagcgacagggtattagggttggcgactacgccaatcaccacggtcagcgccagcagcattttgccgctcacgcttttcacctggatcagcggcgacagcaggtaaatcacaatgatggcgaagaaaaaccacaggtgataaaacaccggcttttgcagcaggtttctcagcgacagctcgccgtttatcgaggtaaaaaacgtaatatagagaaacgccaccagactgtagaacagcaggcagaggccgatgcgcaaaaaatggcgcggctgcgcgctgcgttcaccaaagaacagatagcctgaaatcataaaaaacagcggtacgctgacccgcgacgcggaattgaggatattggccatatcccagtacagtgggctgacgctctgcgcgttggtgatataccagctggtggtgtggatcatcacgaccatcaggcaggcgatgccccgcagattgtctatccagttaatttttgactgcattcgttccccgatttccgtcttaaacaggctctgactcgcgattgccagcgtgttctcactggataattccgagtttcccggcttgcgcttgtacctgccatgctgtgtttgcaatatatttaacagcgcaatcagcctgctccctcttattaaaaataatagccagataacatggcggcgataaaaatgatgatgaagtatgtatttccagcattattactcttactgaccggctgtagcagccctgacgggcagagcgtacaaaaagcgcagcaggcgaaggtcagcccggcccgctcgttgtccatggagcaactgtgcaaagagaacgccgctcaccgctataataccggggcgcagaatattgcagtcaccggctttgtacaatttcaggcgagttatgaagtgcgcggctatacgccccgtgaagaacgttttgtttgcgctttcgatcccgacggtcagtttttgcacctttccatgcgctaaggccacgccacaaacccaattttccctaaacaaccccgtttcgtactgtatatcttgcggtcaacgggtatactggcgacttccttaaatccaccgtatccagcacgaaatattatgcaaaagtttgataccaggaccttccagggcctgatcctgaccttacaggattactgggctcgccagggctgcaccattgttcaaccattggacatggaagtgggcgccggcacctcacacccgatgacctgcctgcgcgcgctggggccagagcctatggcgaccgcctatgtgcagccttcccgccgtccgaccgatggtcgctatggcgaaaacccgaaccgcttacagcattactaccagtttcaggtggtcattaagccgtctccggacaatatccaggagctgtacctcggttccctgaaagaactgggtatggatccgaccatccatgacattcgcttcgtcgaagataactgggaaaacccgacgctgggcgcctggggtctgggctgggaagtgtggctgaacggcatggaagtgacgcagttcacttacttccagcaggtgggcggtctggaatgcaaaccggttaccggtgagatcacctacggcctggaacgtctggccatgtacattcagggcgtggacagcgtttacgacctggtctggagcgacggcccgctgggtaaaaccacctacggcgacgtgttccatcagaacgaagtggaacagtccacttataacttcgaatacgctgacgtcgatttccttttcacctgcttcgagcagtatgaaaaagaagcgcagcagctgctggcgctggaaaccccgctgccgctgcctgcttacgagcgcattctgaaggccgcccacagctttaacttgctggatgcgcgcaaagccatctccgtgactgaacgtcagcgttacattttgcgtattcgcacgctgaccaaagccgttgcagaggcttattacgcgtcccgtgaagcccttggcttcccgatgtgcaaccgaaataaataagaggcggccatgtctgaaaaaacttttctcgtggaactcggcactgaagagctgccaccaaaagccctgcgcagcctggcggaatcctttgctgcgaacgtgacggcggaactggatgccgcgggcatcgcccacggtaacgtggagtggttcgccgccccgcgccgtctggcgctgaaaatcgccagcctcgcggcggcgcagccggatcgtgaagttgaaaaacgtggcccggcgattgctcaggcctttgatgcggaaggtaaaccgagcaaagcggctgaaggctgggcgcgcggctgcggcatcaccgttgatcaggcggagcgtctgaccaccgataaaggcgaatggctgctttatcgtgcccatgtgaaaggcgaaagcgtgcagacgctgctgccgaacatgattgcgacctcccttgctaaactgccgatcccgaaactgatgcgctggggcgcaagcgacgtacacttcgtgcgtccggttcataccctgactctgctgctgggggatgaagtgatcccggcgacgatcctcggtatcacctccgatcgcgtgatccgcggccaccgctttatgggcgagccggaattcaccatcgacaatgccgatcagtatccgcagatcctgctggagcgcggcaaagtgatggcggattacgaagcccgtaaagccaaaattaaagcggacgctgaagaagcggcgcgtaagattggcggcattgccgatctcagcgaaagcctgctggaagaagtggcctcgctggtggaatggccggtggtgctgaccgcgaaattcgaagagaaattcctcgccgtaccgtccgaagcgctggtgtacaccatgaagggtgaccagaaatacttcccggtttacgcggcggacggcaaactgctgccgaacttcatctttgtggcgaacatcgagtccagcgatccgcagcaaattatttccggtaacgagaaagtggtgcgtccgcgtctggcggatgcggaattcttctttaataccgaccgtaaaaagcgcctggaagataatctgccgcgtctgcaaaccgtactgttccagcaacagctcggcacgctgcgcgacaaaactgaccgcatcaccgcgctggcgggctggatcgccggtcagattggcgcggatgtcagccatgctgaacgtgccggtctgctctccaagtgcgacctgatgaccaacatggtgtttgagttcaccgacacccagggcgtgatgggcatgcactacgcacgtttcgatggcgaagcggaagacgttgccgtggccctgaaagagcagtatcagccgcgctttgccggtgatgcgctgccgtccaacccggtggcctgcgccgtcgcgattgccgataaaatggacaccctggcgggtatctttggtatcggtcagcatccgaaaggcgacaaagatccgtttgcgctgcgtcgtgccgcgctgggcgtgctgcgtattatcgtcgagaaaaacctttctctcgatctgcaaaccctcaccgaagaagccgtgcgtctgtatggcgataagctgactaacgctaacgttactgacgacgtcatcgactttatgctgggtcgtttccgcgcctggtatcaggatgaaggctacagcgtggataccattcaggcggtgctggcgcgtcgtccgacccgtccggctgatttcgatgcgcgtatgaaggcggtgtcccacttccgtacgctctccgaagcggcggcgctggcggcagccaacaaacgtgtctccaacatcctggcgaaatccagcgagccgctgaacgataacgttcacgcctcggtgctgaaagacgatgcggaaatccgccttgccatgcaggtggcggtgatgcgcgataagctgcagccggtcttcgctgaaggccgttatcaggacgcgttgatcgagctggcctcgctgcgcgagccggtggatgagttctttgaaagcgtgatggtgaatgccgaagacgcgcaggtgcgtatcaaccgcctgacgctgctggcgaagctgcgtgagctgttcctgcaggtcgcggatatttcgctgttgcagtaagtctcattgcccggcggcgcaggcttgccggacctacatttattttgtaggccgggtaagcgtagcgccacccggcacaaaacataaaacccgccatttggcgggtttaaactttcaggaacacctcaggtacaaagtacaaaaaattattccatcaattgcttacttaatcttgggttggcctggagcaggcgcagcaacttcagttcagtcggggagggttttacccttttagactcccattcatgaaccatcgccacgctcacacccattacccgggcaaaatcatcgtttttcagaccggtacctttacgcagctgctcaaactcactgaaaggattaggtttttgattcaacgtgatagtttgttgcgatacatcgtgtttaaagacaatttgttccagactgctaagcagttcaaacataggatctttatattccattgagaactcctcataaatcacaaggcgtgatcgtaaacgacaacgagccatttaagagtagtcggtaaatattattctggatggttgcgagagtgattaattgtcaggtaatggacctttatatactaaaaataccttttttcttgtccaggctctctttaatgccttgatcattaagccctggtttttagctgtagacttttgtaaatgatcagcaaaaaaaatactaagcattgccggtacgcactaagcgtagcgggggccgcagagcaattccgatgcggggctttccctgacaagaatgtcaggaaagggtatcttgcaaagccgacctggactatccttgtcagcgtcgggcacgtgtgtgccggtgtgcgcttttttgggtgaaaggagtaataaaatggcgacaggaaagtcctgctctcgctggtttgcgcctcttgcggcgttattaatggtggttagcctgagtgggtgttttgataaagaaggcgatcagcgcaaggcgtttatcgattttctgcaaaatacagtgatgcgcagcggtgagcgtttgcctaccctgaccgcggatcagaaaaaacagtttggtccctttgtatcggattacgccattctttatggttattcccagcaggtgaatcaggcgatggacgcgggtctgcgtccggttgtagacagcgtgaatgccattcgcgtgccgcaggattacatgacccagcgcgaaccgctgcgtcaggcaaacgggtcgttaggcgtgctgagccagcagttgcagaatgcaaaaatgcaggcggattcttctcgtgccgcgctgaaacaggccgatgatttgaagccggtttatgaccaggcttatcaaaaagtggttaccgcgccgtcaaacgcgctgcaaccgctgatcccggctgcacaaatctttacgcagcaactggttcaggtgggtgattttattgcccagcaggacacacaggtgagctttgttgctaacgggatccagttcccgacttcccagcaggccagccagtataactcgctgattgggccgctggcgtcgcagcatcaggcgtttacacaagcctggaccgctgccgttaacgcgacgcaataagcgtttcgtccccccgccaaaaagcggggggatccgccgcttcgctgaggccctggccttgtggacggctgaaataagtcttgctaagcctccgggataatgcgttaatgctccccggtttgacgtacagacctaaagcactttataaagcagtccctccaggagttatccatagatacccttcgttgagagctttcctttatcgcttaaaatctgtaaagcacgccgtagcgccggaaggcaaacttaattaaaaaggtaatctctatgtctggtaaaatgactggtctggtaaaatggttcaactctgacaaaggcttcggcttcatcactcctgacgatggctctaaagatgtgttcgtacacttctctgctatccagaacgatggctacaaatcccttgatgaaggccagaaagtgtccttcaccatcgaaagcggcgctaaaggcccgtctgctggtaacgttgtaagcctgtaatcgcttccgtttaaagcacgctttctaaaaaaaaccccgccatgcggggttttttcttttctggcttccggctatttcgcgatctgcggattcacacagtttttctctactttgccattgagcgcgtcgatcagattatccaccgcgcaggcggccatgttgtaacgcgtttcaaaggtggcggaaccgatatgcggcagggcgaccacgttcggcagcgacagcagttccgaatctgccggcagcggctcctgttcgaaaacgtccagacccgcagcatggatctcgccgttcttcagcgctgcaatcagcgctttctcgtccaccaccgggccacgaccggcgttgataaagatcgccgaggatttcatgcgggcaaactgatccgcgccgatcatatggtgcgtctcatccgttagcggcagcaccaggcagacaaaatcggcttcttccagcagggcatccagttcacagtaacgcgcgccaaagcgctcttccgcttccgtatgatgacggcgggcgttatagaggatcggcatgccgaaaccaaagtgcgcgcgctgcgccagtgccagaccgatgcggcccatgccgacgatgcccagcgttttatggtgcacgtcgatgccaaaccagtccggcccgatgttttttgtccattcgcctgcttttacgcgctccgccacttccaccacccgacgggctgtgctcagcaccagcgccatcatggtatcggccacggtttcggtcagcacggtaggcgtatgcatcagcaggatcttacgatcgtttaacgcatccacatcgaagttgtcatagcctaccgagatggtcgacgtggcgcgtagcttcggcattttctccagcagcgcggcgtcgactttctcgcttgaacccagcaaaccttccgcactggcaaatgcctctgcatgttgttgcaccgtctccggatgcagattcggcaccctggtgacggtgaaatggtcttccagacgtttttgtagatcatcaggcatggctttgtacagaataatggacggcttcatgcggttctcccaaatcagtaatagcgggtcgtcaggcgcatcatgcgtggcgcgcgcccgccggaatctgttgattattagcaggcttaacaatcagagtaagccataccgagacaaaaagcgccacccccataaagatgtacgatgccgccgggctgcctgtcgatccgttgagataacccacgaaccaggagccaaagaaagagccaagcgcgcccatactgttgatcagcgccatcgcgccacccgcgacattacgcggcaacatttccgggataatggcgaagaaagggccgtaaggcgcatacatcgccgccccggcaatcaccagcagcgtataggaaacccagaaatggttcgcccctacggcccaggagccgataaaggcaaaggcggcgatcaacagcagcggccagacaaagagtttacggttttgcattttgtccgacgcccatgaggcgaggatcatcgcaatggtcgccgccagataaggcaccgaggagagccagccgaccgccaccataccgagattttcaccgccgctgtgaataatggacggcagccacagcacaaagccgtacacgccgatactccaggcaaaatactgcatacacagcaggatcacgttgcgcgaacggaaggcttcgccgtaattacgcaccgctttaataccctgttgttcctgctccagctgcgcctgcaacgcggctttttcctctgccgccagccatgacacctgcgacggtttatccctgaccagcacccaccagcagaatgcccagagcactgccggtacgccttcaataatgaacatttcgcgccagccgaaagactggatcaggtagccggacaccaccgacatccacaacaccgtgaccgggttacccagaataaggaaggtattggcgcgcgagcgttctgatttagtaaaccagttgctgatataaatcagcatcgcgggcatcaccgccgcttccaccacgccaagaataaagcggatcgccgccagcgccggaatattatttaccacgccggtgagcgaggcgcaggcgccccataagatcagacaaataaagatcaatttccgcacgctgcggcgttcagcgtacattgcgccggggatctgaaagaagaagtagccgaggaaaaacagtgcgcccagcagcgatgagacgcctttagtgatgccaagatcgtcattgatgcctgccgcggaagcgaagctaaagttggcgcgatccagataagccaggctgtatgtgataaacacaatcggcataatgtacagccagcgttttgttgcattagtcggacttttcatagggttgcctctggcattgtagggtactgaggttcaaatatgataaagaggggcgctttacccctcgttaagctgtgcccgcgttggcaatccttcgctgtctccctgcacctgaatggccagtgagccgattttatttccccgatcgatagcctgtttaagtgagcggccttccagcagcgcgctgaccaggccgaccgcaaagccatcgcctgcgcccacggtatccaccacgttatccactttaatcgccgccaccgccccctgctcgccgtcggcggttttgaaccacgcgccgtcagagccggctttgatcaccacgattttcacaccacgtgacagatagaaatcggcgatgccttccgggtgttgctggccggtaaggatgacgccctctttcagccccggcagcacccagtcggcctggaacgcgaggtgattgagtttctcgaccatctcggcttcgctcttccacagcactggccgcagattaggatcgaaagagatcgttttgccgcgcgctttcatcacgcccgccgcatgatccagcagggcatacgcatcagacgacaaggccgccgccacgccgctcagatgcagatggcgcgcgctggtgaacatgccttcgtcgaaatctgccagcgacaaatggctcgccgccgagttcttgcggaaatactccacgatgggatcggttccattttcaaccttagatttcagctgaaaacccgttgcgtaccgcccgtcaatagtgacgccgccggtgccgatgccctctttttccagcgaattcagcacgaactgcccgaagctgtcatcgccgacgcggctgacccaggcgactttcatgccgaggcgcgcaaggccggtggcgacgttcagctcagcgcccgcgatgcgtttaaaaaagtgctccgcccgggccaggtcgccggtttcggtggcgacaaacatggccatggcttcgccgatggtgatgacatccagcgcatgatgcatggcgttactcctcacgtaataaattgacatagcggcgcgtgacggcggtcagatcgcggccttccagtggaaactcaatgccgcgcggcacgtcggcgggaagctgattcagcagttccgcccagcggccgtcggcctgatccggcgcaatggcgcgataatggtaatgatgcgcgatagcggctttcacatggatatagctgacggcgggggccagctggcgggccgcttcttccggcgattcgccgacccacaaccagttcgccatatcgaaggtcagggtgaccggcagatccagcacccggcaggcggctttaaaacgctgcatcggcgcaagctggccgcaatcggtctgatcgttttccaccaccagcgtcatgccgctgtccgccagccagccgcgcagcaactccagcgcggatttgtgctggaaatgcccgagagagactttcagccacagggcgtttaaggtgcgcgcttcctgaagcagagcgggcagttcggggttcagcgtgccgtcaaacagacacagcggctccggcgcggagtagcaggccagcaggttatgggattcgatgtcggcggccagggcaggcagggcgttcagttcatcaggcgtgaacaattcgcggcggatctccacgccgtctgcgcctgccgccgcaataaacggcagcacggcagcctgaccgcccagcgactgaatacggtcgtggccgtaagcggcagtgacgacgataatttttcttttcatttcccggctcccgaacaaatgcctgttggcttctgtttaagctagatggaaccggttccaaatgaaaggtcaggatcgccaaagcatgatcgtcatcacgaaggggaatcagcgggcggtggagccgcgaacgataagttcgccggagaagacctgttcatgcacggtattgtcggtgccgtcgatgcggcgcaccacctgctcgacggcggcgtagccaatctgccaggtaggctgtttgagggtggtgatgccgacgcccgcaagctctgcccactccagttcgtcaaaaccgagcagaccgatgtcgctgccccagtgtaggccaatgcgcttcagcgagcgggcaacctggagcgttaatgcgccgttggcagagatcaccgctttgcgcatgccccggtgacgggtatgaaactggcgcagcctgttgtcgatttgcccggcttcatgcagcacaacttcagcatcttccgcaatgacgccgggatagcgggcgagggtggcatgaaaggcgttcagacgctcacggcgggtattcaccgtgccgagaggttcactaagaaacagcagcgcttcaaatccctgctccaccagatgttcggtggcggtggtggcggcctggatgttatccagcccgaccacatcgcaggcgaagtccggaattttacggtcgataagcaccatgggcagcgacgattgttgcaggcggttcagcccctcttcgcgcattcccacggcattcaccacgatcccctccacctgataactgcgcagcaaatccagatagtgcagctcctgatcgagggcgttattggtattacacaccagcggcgtaaagcctttctcacggcaggcagcttcgataccgctcagcacgttcacggaatagggattggtaatatcggcgatgatgaggccaatcagccgcgtacggccgcgtttcaggccgcgggccatcaggctgggacggtaattaagttcggcaatggcgttttcgatgcgggccagcagagcctctgaaagcagatgcttttcaccgttcagataacgtgaaatgctggttttacccgtttttgccgctttcgcgacgtcgctgattgtcgggcgcgctgcctttgcgttcatgtccgtctcctggggtaactttgcggagattaacatattttacgcggaatacccctcgcctgcaggcgagggggtaaacagagggattactgcaacggactcagggtaatttccacgcgacggttctgcgctttgccttcttccgtgctgttgctggcaatcgggttcgccgggcctgcgccggtagtacgcagacggttcgcttccacgccctgggtgatcagcgcgctggcaaccgcatcggcacgctgctgcgacagacgcatgttcagatccttgccgccggtgctgtcggtgtaacccaccacgttaaccgcggtttttgggtactctttcagtaccatcgccacgccggtcagggtattggcacctgccggtttcagggttgcgctgctgctgtcgaaggtcacgttgttcggcatgttcagcacgatgttatcgccatttcgcgtcacgctaacgcccgttccctgcattttgtcccgcagtttcgcttcctgcacgtccatgtaatagcccgcgccgccgccgagggctgcaccggccgccgcgccaatcagcgcccctttgccgcggtcttttttcgaggaggagagtacgccgacgcccgcgccgaccagcgatccaatgcctgcgccaatgcctgatttaccggcttcgcgctcaccggtgtaagggttggtggtgcagcctgaaacagccagtgcgccgcaaaccgcagccacaatgagaaggacatttttcttcatcgaatttccttaataatttttaattctatgcacagcgataatcgcggttgattatgacctgatgatcgttagaaacttccggaaagattctgaattttgtaaataacattgagcggcgcatgagcgaccgacacacctgcatcagacatcagggagcatacgttttggcacactcatccacaaaaaccattctcacggcagcccactgggggccgatgctggtagaaaccgacggcgaaaacgtcctgtcatcgcgcggtgccctgccgaccgcccatcccaattcgttacaaaccgccgtgcgcgatcaggtgcacagcaacagccgcgtgcgtttcccgatggtgcgcaaaggcttcctgacgtcaccggaaaaaccgaccggcgtgcgcggtcaggatgagtttgtccgcgtcagctgggatgaagccctggatctgatccatgcccagcacgtccgtattcgtgaaagctatggcccgtcgtcgatattcgccggatcttacggctggcgctccaacggcgtgctgcacaaagcggcgacgctgttgcagcgttatatgagcctggcggggggctataccggccatcttggggattattccaccggcgcggcgcaggcgatcatgccctacgtggtgggcggcaatgaggtttatcagcagcagaccagctggccgctggtgctggagcattctgatgtggtggtgttgtggagcgccaacccgcttaacactttaaaaattgcctggaacgcctcggacgaacaggggatcccttatttcgatcagctgcgccagagcggcaagcgggtgatctgcatcgatccgatgcgatcggaaaccgtcgacttcctcggcgacagtgccgaatggctggcaccgcatatgggcaccgatgtggcgttgatgctcggcatcgcccacacgctggtggaaaacggctggcaggatgatgaattccttgcccgctgcaccaccggttacgacatcttccgcgattatttaaccggcgccagcgatggcgtggcgaaaaccgcagaatgggccgcggaaatttgcggtattgatgcgcctaaaatccgcgaactggcggaagtgttccataaaaataccactatgctgatgtccggctggggcatgcagcgccagcaatatggcgagcagaaacactggatgctggtgacgcttgccgccatgctggggcagatcggtctgccgggcggcggctttggtttgtcctatcactttgccaacggcggcaatccgacgcgccgcgcggcggtgctcggctccatgcagggcagcgttcagggcggcgtggacgcggtggataaaatcccggtggcgcgcattgtggaagcgctggaaaaccccggcggcgcgtaccagcacaacggcatggatcgtcatttcccggatattaaatttgtctggtgggcgggcggcgcaaactttactcatcatcaggacaccaaccggctgatccgcgcctggcaaaaaccggagctggtggtgatctctgaatgctactggacggcggcggccaagcatgccgacattgtgctgccagccaccacctcttttgaacgtaacgatctgaccatgaccggcgattacagcaatcagcatctggtgccgatgaagcaggtggtcgccccacgtgatgaagcgcgggatgattttgaggtgtttgccgatctcagcgagcgctgggagcagggcgggcgggcgcggtttaccgaaggcaaaagcgatctgcaatggctggaaaccttctatgacatcgccagcgcgcgcggcgccagtcagggcgtgacgttaccgccgttcgcagaattctggcaggccaatcagcttattgagatgccggaaagcgaggagaacgcgaagtttgtgcgttttgcggccttccgtgccgatccggcggcgaacccgctgaaaaccgacagcggcaaaattgaaatctattcgcagcgtatcgcgtcatttaactatgccgactgtccggggcacgcgacctggctggcgcctgacgaatggcacggcaatgcggagccgcagcagttgcaggtgctgtccgcgcatccggcgcaccgtctgcacagccagttaagctattccgcgctgcgcgagcagtacgcggtggcggggcgtgaacccatcacgctgcatccgcaggatgcgcaggcgcggggtattcgtgatggcgacctggtgcgcgtgtggaacggtcgtgggcaggtgctggcgggcgcagtggtgaccgaggggatccgtccgggggtgatctgcattcatgagggcggctggccggatctggatccggcggccggggggatctgcaaaaacggtgcggttaacgtgctgaccaaagatctccccagctcgcggctgggcaacggctgcgccgggaacacggcgctggcatgggtggaaaaatacaccggccctgagctcaggctgacggcgtttgagccgcctgccagcgcatgatccacgtcgggtggtgagtctcctcctgccaggcgctgtcttcgatacgaaagcccagcgcatggtagaaattcactgcccgctcattcttctgatacacctcaagactgagatcggcatagcgctgtttgacatgctcaagcagcgcgcgtccgatccccttgccgatcgcgtcaggacgcacaaagagcgcaccgacaaagcggctgtccatcacgctgacgaatccctcaaggcgaccctgttcttcccacacccaggttctggcggcgggtaaataggcatcgcgcaccaggcttttactctcctgccagtaacgcgcgtcgataaaaggatgggcaaaggtggtgctttccagccacagcgccagcagcgctgacgggtcattatcataccattcgtggatcatcgctgcctccgggatgacaaaagcactgggtaacatggtcattcaccagaccgcaggcctgcataaaggagtaacagatggtggtgccgacaaacttgaagccgcgttttttcagcgcttttgacagggcatccgattccggtgtcgacgtggggatctccgcaagggtggcggcctgggtcatcctgacctgatgatcaacaaaagaccagacaaaatctgcaaagtcttccccctgttgctgcatcgccagataggccctggcgttgccaataatcgcctgaatttttccccgatggcggataataccggcgtcctgcaacagcctttctacgtcgtcaccctgcatcgccgccacgcgtacaggatcgaagttataaaaacagcggcgataattttcccgtttcttcagcactgtgatccaggataaacccgcctgctggccttcgagacagatcatctcaaacagcttctggttactggactgcgccacgccccactctttgtcgtggtagtcgatatacagcggatcctgactgacccaaccacatcgttgcatgtctttctcctttccattgttgcggtagatcccaaaagaaaattatcccgctggcttgacgtgtctcttaaagagacaatagttaatacagggttttatccgcacaaaatgataacgatactgccggttttggctcttttctggagtcgcattgatgaagataaaaaataacagtggctgccgcctggcgctcgtgcctgtgtgcctgtttttttgtcagacggcgcaggcgtggcaacaagaatatatcgttagcgacccgcaaagtaatatggcggatcgctatacatgggacagcgatcaccaaccgcgttatgacgatattctcgaagggcggatccgctcgacgcaaaatacgcctggcctgtcctggaatttgccggatgatacgccgctggacgccaccagcaccatgagcctcggctggaatattccgctggtgaataatgtcaccaccggcccggtggccgtctggcattacgacagctctgcctcatcaatgcataatgaatttggcgatggcccggcaaacctgcaattcaccgatccgctgtggcatgccagcgtcagctcagtgggctggcgcgtggacagtcgtcacggggatctccgcccgtgggcgcaaatcagctacaaccagcagtttggcgaaaatatctggaaaacccagtccggcctcaatcgtttatcggcctccagccaggacggtaactggatggacgtgaccctcggcgcggatatgctgctcaatccccattttgcagcctatgcttcattgtcgcagtctgaaaatacggacatcggtcaaaactatctttacagcatgggcgtcagcgcgcgcttttaattagcatttaaaacaaattaattacattttttatacaacaatcatcagcttcgcagagatagtgtgtactaacttacactgtattttttgctgatgagacttttcccgctgtcattcattcccgttacaaggcatttcattccgtcctcactgcatttcatgccgttttcgatccggcatcaacggcgcttcgttatggttaacggcagagaatttcccttttgcttacgcaggaagactgccatgaatacatcctcattgaatcggacccgctggctgacgctggtcggtaccatcattacgcaatttgcccttggatcggtttatacctggagtctgtttaacagcgcgctggcggaaaaactggatgagccagtaagccaggtggcgttctccttcggcctgctcagcctcgggctggcgctctcttcctcggtagccgggaaattacaggaacgtttcggcgttaaacgtgtgactatcgcatccggtattctgctgggcctcggctttttcctgacggcgcacgccaacagcctgctgatgctgtggctgagcgcgggcgtgctggtcggccttgccgatggcgcgggctacctgctgacgctctccaactgcgtgaagttcttcccggagcgtaaggggctgatttccgctttctccatcggttcttatggcctgggcagcctcggctttaaatttatcgacagccatctgctggctaccgtcggcctggaaaagacctttatgatctggggcgcgatggtgctggtgatgatcgtttccggcgcgatgctgatgaaagacgcgccgcagcagaaagcgaccatggtcaatggcgtggtggagaatgatttcaccctggcgcagtcgatgcgtaaaccgcaatactggatgctggccgtgatgttcctcactgcctgtatgagcggtctgtatgttatcggcgtggcgaaagatatcgctcagggcatggtgcatctggatgtggcgaccgccgccaatgcggtgactgtgatttccattgctaacctgacaggccgtctggtgctcggtatcctctccgataaaatgtcccgcatccgcgtgattacgctcggtcaggtggtgtcgctgattggtatggcgggactgctgttcgccccgcttaacgaagtgagcttcttcgcggctatcgcctgtgtggcctttaacttcggcggtaccatcacggtcttcccgtcgctggtcagcgaattttttggcctgaacaatctggcgaaaaactacggcgtcatttatctgggctttggtattggcagcatctgcggctcgattatcgcctcgctgtttggcggcttctatgtgaccttctgcgtcatcttcgccctgctgatcctctccctggcgctttccaccaccattcgtcagccgcagcgtgaatacttcaccaactcacagccgctgactcaccattaagtgacctgcgccacgctctgcgtggcgcttcgcaatcttcaaccttctcccttcctgaatcaggggtaatacggtaagctctgccgtattacctattatttttgtaaatgtttagtcagatcacattcccggtgacacttttttccacccctgtggtctactaccccgcgcttcacgaagttatcgaatcaacttcttatgcgtttgataagcctatatgcagatatatcgtctgcgcacgggtgctctctattcccttctcccagggtgctttgaatgaaatatatcaaaacgatgacgcaacaacggctgagttttttgctggcgttgtacatcggtctgtttatgaacgccgctgtttttattcgtcgctttgatggatatgcgcaagaatttaccatctggaaaggcctcgctgcgattgttgaagtggcgggtacggtattagtcacgttctttttacttcgacttctctctctgtttggacggcgtgcctggcgcgtgctgtcgacgctggtggtgctgttttccgcaggcgccagctattacatgactttcctgaacgtggtcatcggctacggcattgttgcctcggtgatgacgacggacattgacctgtcgaaagaagtggtgggcatgcagtttgtgatctggctggtatgcgtgagcacgctgccgctgatctttatctggagcaacagcagccgcctcacgctgctgcgccagctgcgtacgccgggcctgcgcatccgtagcgcggccatcgtcgtgctggccggtttgatggtctgggggccgatccgtctgctggaagtgcagcaaaagagcgtagagcgcgcgaccggcgttgatatgccaagctatggcggcgtggtggctaactcttatctgccgtctaactggctgtccgcgttagggctgtacgcctgggcgcaggtggatgagtcttctgataacaaatcgctgatcaacccggcgaccaaatacacttacgttgcgccgaaagatctcgatgacacttatgtggtctttatcatcggtgaaacgacccgctgggatcatatgggcctgctcggctatgagcgcaacaccacgccgaagctggcggcggagaaaaatcttgtcgccttccggggttactcctgcgataccgccactaagctgtccctgcgctgcatgtttgtgcgcgagggcggggcggatgaaaacccacagcgtacgctgaaagagcagaacgtttttgcggtgctgaaacagctcggcttctccagcgacctgtacgccatgcagagcgaaatgtggttttacagcaataccatggcggataacatctcctaccgtgagcagattggcgctgagccgcgtaaccgcggtaagaacgtcgatgacgcgttgttgctggatgaaatgaaagcgtcgctgaaaaacagccctgacggcaagcatttgatgatcttccacacgaaaggctcgcactttaactacacccagcgttatccgcgcagctttgcccagtggacgccggagtgtcagagcgtggacgacaagtgcaccaaagcggagatgattaattcctttgataactccgtgacctatgtcgattactttattgatagcgtcatcgatcagctgcgcgataagaaagcgattgtgttctatgccgccgaccatggcgagtcgatcaacgagaaagaacatctgcacgggacgccgcgtaaaatggccccgcctgagcagttccgcgtgccgatgatggtgtggatgtctgataagtatctggagaatccggagaaagccaaaatgttcgcgcacctcaagcagcaggccgatatgaaagtgccgcgccgccatgttgagctgtatgacaccatcatgggctgcctgggatatacctcgccaaatggtggtatcaacgagaacaataactggtgccacatcccggatacaaaggcatcggcgggtaagtaaactgactggcgagtttatcgccagtcgaaaggcttttttacgttaagggattgacggttgcggtgcccggcagtaagatgcgccccgcattcggtgattggcgcagcctggtagcgcacttcgttcgggacgaaggggtcggaggttcgaatcctctatcaccgaccaaatttaaaaagcccaaccttctggttgggctttttgctatctgtggttcgggaggatgagaagctccgggggaggaggttcgcgccgagcgaagcgagacagcgttgcgcagcaacgacccgaagggcgagccacagcgtggcgagtaatcctctatcaccgaccaaatttaaaaacccgtcgtggaaacacgacgggttttttgcattttccgccgctcctgtaggccgggtaagcggagcgccacccggcggaaataacacttttaaatcacgcgtcgatatcgctcataattctctgcatttgccagatattccatcgtatttttttatatatgtttgaatcttttttcgcgttgcttatggataagctcagcattttcacctgtgcgttttaacgttcgcggtattaatcgctcagatattcatcattccgtcagaaatttttcataaactgggtaaatgttaatcactgatgtgagacttaaaagcagcggtttattctggcatccgaccagtagcacaattttccctgctgaaaacaggggcgtgcactttttttaatctttgtttgccaattctcaccgtcgttgtaaatcccggttacctgtattgacgttttgacattctgttgacagattgtagggcatgaggggcatttcacggagaatctgcactgcaactcagtcaaccttgtgaaaggattccccatctctcatatagcctccgggcacaaccgaccagaccggtaaaaaataaataaaggcctgtcggatataccctttgcaacgggtaaacaacacatatcacattggagcagaataatgagtatttccttgaagaagtcagggatgctgaagcttggtcttagcctggtggccatgaccgtcgcagcaagcgtacaggccaagaccctggtttattgttcagaaggctcgccggaaggctttaacccacagctctttacctctggtaccacttacgacgcaagctcagtgccaatctacaaccgtctggttgaattcaaaattggtaccaccgaagtgatcccgggcctcgctgaaaagtgggaagtcagcgaagacggtaaagtttataccttccacctgcgtagcggtgtgaagtggcaggacaacaaagatttcaaaccgacgcgtgaattcaacgccgacgacgtggtgttctcttttgatcgccagaaaaacgctgaaaacccgtaccataaagtgtccggcggcagctatgaatacttcgaaggtatgggcctgccagacctgattagcgaagtgaaaaaagtggacgacaaaaccgtacagttcgtactggcgcgtccggaagccccgttcctggctgaccttgccatggacttcgcttctatcctgtctaaagagtacgctgacaacatgctgaaagccggtacgccggagaaaattgacctgaacccaatcggtaccggtccgttccagctgcagcagtaccagaaagactcccgcattctgtacaaagccttcgaaggcttctggggtactaaaccgcagatcgaccgtctggtgttctctatcaccccggacgcgtctgtacgttatgcaaaactgcagaaaaatgagtgtcaggttatgccgttcccgaacccggctgacattgcacgcatgaagaaagacaccaaaatcaacctgatggagcaggccggtctgaacgtgggctacctctctttcaacaccgagaaaaagccgtttgatgacgtgaaagttcgccaggcgctgacctatgcagtgaacaaagaagcgatcatcaaagccgtttatcagggcgccggtactgccgcgaaaaacctgatcccgccaaccatgtggggttataacgacgacgttaaggattacacctacgacgttgagaaagcgaaagcgctgctgaaagaagccggtcaggataaaggtttcaccgttgaactgtgggcgatgccggtacagcgtccttacaacccgaacgcacgccgtatggctgagatgatccagtctgactgggcgaaaatcggcgttcaggccaaaatcgtgacctacgagtggggcgagtacctgaagcgtgcgaaggcgggcgaacaccaggcggtgatgatgggctggaccggggacaatggggatccggacaacttcttcgccaccctgttcagctgcgacgcggcgaaacaaggttccaactactctcgctggtgctacaagccgtttgaagatctgatccagccggcacgtgcgactgacgatcacaacaaacgtattgaactgtacaaacaggctcaggtagtgatgcacgaccaggctccggcgctgatcatcgcgcactccaccgtgtacgagccagtgcgtaaagaagtgaaaggctatgtggttgatccactgggcaaacaccacttcgaaaacgtgtcagttgaataattaaaacccagggggtgcgcacgcaccccatgcccggcggcgctacgcttgaccaggcctacacccgtaggccggataagcgcagcgccatccggcataatgctttacctgagcggtatccgcgcaggataagatttgtgagcaatacagacacgtctttgacgctgtcactacagagaatccgggttatgttgcagttcatcctccgacgtctggggcttgtcatccctacgtttatcggtatcacccttctcacctttgcctttgtccatatgatcccgggcgacccggtcatgatcatggcgggtgagcgtggtatctcccctgagcgtcacgcgcagttgctggccgagcttggcctgaacaagccgctgtggcagcagtacgtcaactatgtatggggcgtgttgcatggagatttaggggtttcgcttaagagccgtctcccggtgtgggacgagtttgtgccgcgttttaaagcgacgctggaactcggtgtctgcgccatgatatttgctgttgccgtgggtattccggtgggcgttctcgccgccgttaaacgcggttccatctttgaccacaccgccgtcagcgtcgcgctggccggttactccatgccaatcttctggtggggcatgatgctgatcatgctggtgtcggtgcaactcaacctgacgccggtatccgggcgcgtcagtgacatggttttccttgatgatactaacccgctgaccggctttatgctgatcgacaccgccatctggggtgaagagggcaacttcattgatgcgctggcgcatatgatcctgcctgcggtggtgctcggcactattccgctggcggtgatcgtgcgtatgacccgctcatcaatgctggaagtgctgggtgaagactacatccgtaccgcccgcgcgaaaggcctgacccggatgcgcgtgatcgtggtgcatgccctgcgtaatgcgatgctgccggtggtcacggtgatcggcttacaggtgggcaccatgctggcgggcgctatcctgacggagacgattttctcctggccgggactgggacgctggttgatcgacgcgctgcaacgccgcgattacccggtggtgcagggcggcgtgctgctggtggcgacgatgattatcctcgtcaacctgctggtcgatctgctttacggcgtggtgaacccgcgtattcgtcataagaagtaaggggccatcatgtcacaagtaactgaaaataaagcggtgtccgcaccggtgccgatgaccccgatgcaggagttctggcactattttaaacgcaacaaaggggcggtagtcggcctggtgtatatcatcgtggtgctgattattgccatcttcgccaactggatcgcgccttataacccggccgaccagttccgtgactcgctgctcgcgccgccggtctggcaggaaggcggtagctgggcgcatctgctcggcaccgatgacgtaggccgcgacgtgatgtcgcgtctgatgtacggcgcgcgcctgtcgctgctggtcggctgcctggtggtggtgctgtcgctggtgtccgggattatcctcgggcttatcgccgggtatttcggcggcctggtggataacatcattatgcgcgtggtggacatcatgctggcgctgccgagcctgctgctcgcgctggtgctggtggcggtctttggcccgtccatcgtcaacgcctcgctggcgctcaccttcgtggcgctgccccattacgtgcgcttaacccgcgccgcggtaatggtggaagtgaaccgcgattacgtcaccgcctcccgcgtggccggtgccggtgcgatgcgccagatgttcgtgaatatcttccctaactgcctagcgccgctgatcgttcaggcgtcgctcggcttctctaacgccattctcgatatggccgcccttggcttccttggcatgggtgcgcaaccgccaacaccggagtggggcaccatgctgtctgacgtgttgcagttcgcacaaagcgcctggtgggtcgtgaccttcccgggtctggcgatcctgctgacggtgctggcatttaacctgatgggtgacggcttgcgtgatgcgctcgaccccaaactcaagcagtaaagggctacgaaatggcgttattaaatatagataaattatcggtgcacttcggcgacgaagggacaccgttccgtgccgtagaccgcgtaagctacagcgttgagcagggtgaagtggttggcatcgttggtgaatccggttccggtaaatccgtcagctcgctggcgatcatgggactgattgatttcccgggccgcgtaatggccgacaagctggaattcaacggccaggacttaaagcgcatctctgaaaaagagcgccgcagtctggtgggcgcggaagtggcgatgattttccaggatccgatgaccagccttaacccgtgctacacggtgggtttccagattatggaagccattaaggtgcatcagggcggcaacaagaaaacccgccgccagcgtgccatcgacctgttaaaccaggtgggtattcccgatccggcctcgcggctggacgtttaccctcaccagctctccggcgggatgagccagcgcgtgatgattgcgatggccatcgcctgtcgtccgaagctgctgatcgccgatgaaccgaccaccgcgctggatgtgactatccaggcgcagatcatcgaacttttgctggagcttcagcaaagggagaacatggcgctgatcctcatcacccacgatctggcgctggtggcagaagcggcccataaaattattgtgatgtatgccggtcaggtggtggaaaccggcaaggccacggatattttccgcgcgccgcgtcatccgtacacccaggcgttgctgcgcgcgctgcctgagtttgcgcaggacaaagcgcgtctggcctcgctgccgggcgtggtgccgggtaaatatgaccgtccgaacggctgtctgctgaacccgcgctgcccctatgccaccgatcgctgccgcgtggacgagcctgcgctgaatacgctgagcgatggccgtcagtctaaatgtcactacccactcgatgatgccgggaggccgaattatgagtacgcatgaggccaccctgcaacagccactgttgcaggctatcgacctgaaaaaacactacccggtgaagaaagggctgtttgccccggaacgcctggtgaaagcgctggacggcgtctctttttcgctggagcgcggtaaaacgctggcggtggtgggcgaatccggctgtggaaaatccacgctcggtcgtctgctgaccatgatcgaagtgccgaccggcggcgagctttactatcaggggcaggatctgctcaagcctgatatgagcgccgaaaagctgcgtcgccagaagatccagatcgtcttccagaacccgtacggttccctgaacccacgtaaaaaagtgggccagatcctggaagagccgctgcaaatcaacaccacgctgagcaaagaacagcgccgtgaaaaagcgctggcgatgatggcgaaagtcggcctgaaaaccgaacactacgatcgctacccgcatatgttttccggcggccagcgtcagcgtatcgccattgcccgcgggctgatgctcgatccggacgtggtgatcgccgatgaaccggtgtcggcgctcgacgtgtccgtgcgcgcgcaggtgctgaacctgatgatggatttgcagcaggatctggggctgtcttacgtgtttatctctcacgatctgtccgtggtggaacacatcgccgatgaagtgatggtgatgtacctcggtcgctgcgtggagaaaggcaccaaagagcagattttctccaacccgcgtcatccgtatacccaggcgctgctctctgccacgccgcgcctgaacccggacgaccgccgcgaacgtatcaagctgaccggcgagctgccaagcccgctgaatccgccgccgggctgtgcctttaacgcccgttgtgttcgtcgcttcggtccctgcacccagttgcagccgcagctgaaagagtacggcggccagctggttgcctgcttcgcggtggaccaggacgagaatggcgaaaagccgattgttcacggttgattaaccctgcccggcggcccatgcctgccgggaccggggcagcaccgattttccaggccgggtcaggcgtaaccgccgcccggcaatttaagcacccgtactggctgcttaaaatcctcttttgaaccacctgactaatgcaaaagactgactatttaggataagataatactttgcactaataatgtggttattcatgaaagtataagactttacttattccgacatcaaaaaaagatagcatcctggcgggcaaaatttatatatttgctgccgttaagtggtgggttaaaaacgccctataaaatcacccactaaattagcttaacgcttcaccctgttattatacccgcacgttattattaattacgccaccttatcagtgaaatgcttttaagaagcattaaaggttgattgtaatattttttatttgtaaatcatgagtataactatgaaccattatgatgatttgcagaggtttaaggataagactcgcactcagcatctcgattttaaggatttgtcttcccagaatcagggtagcgagcaggggaactgggcgattattaatcagctgtcgcccgctactgaagaatcgacgctggcgatgggtggacacgtttctgctgctattccccaggcggttaatcctgaaatcttcgcagtaaacccaaccacgccgcctgctgacgctatgactcacgcgtcacctgagtcagcgcccgtgacgacctcccttttccaggacgtggcctcacagctgtctgtcccgccgcaacccgaggccgcgcctgcgccagccatcacgcctgcggctccgccgtctgcgcccgagcctgtcgccatcgcgcctgcgccgctgcggtcagttacccctgcgcctgccgccgcaccggtgaattttgcgcagctgtttgcgccaaaggtcacagagacgaaaccggccgcagaaaagaaccagcccctgaaatcgctgttagaaaggatcgcttcatgccgttgatctgtgtctgttcgcccaagggcggtgtcggaaaaacaaccatgaccgcgaaccttgcttacgcgctggcacgggcgggaagcaaagtgctggcgctggattttgacgtgcagaacgcgctgcgcctgcattttggcgtgccccttgccgatggccgcggttttgttgcccgcgcggcagagttgcctgactggagccagtttgtattatcggcaggcagcaacatgttcgtgctgccttacggtgacgccaccgaagcccagcgcgaagcctttgaagatcgcctgacgcacgacgagcattttctgacccgcgggctgaacaccctgcttaattatccgggtctgatcattatcgccgatttcccgcccggcccctcaccggcattaaaagcgctgtcacgccttgcggatctgcatctggtgaccctgctggcggacacggcgtctctctcgttattaccgcaggtggaaaaccaccgtcttaccggcgatgtgctgaaccgcaaagcggggcattacattctgctgaaccagagcgacaaccgtcggcaaatcagccgcgacgtgacggcctttatggagcagcggctgggtgagcgcctgattggtatcgtgcatcgcgatgagagcgtcggggaagcgaacgcctcgcaacagtccgtcttcgatttcagcccggcctccgccgcggcctttgatattgagctgattgccaaaaagatcgccaatatccttgatgtgaaagttggcgatggcaccgttcataaccttccgaagatgtctggtttctaattctccacagagcgatttatgaaaaagttcctgttttatttgctggtgctggcactggcgcctgctgccgtgctggtcgtcattacgcccatggacagccagaaacagtatatttttggattgatcagcatcgggattttattcctgatgggcttttctaaaaaacgtagcatttcggtgatcatggtggtgatgtcgatattaatgtcgacccgctatatgtatttccgcgtcacgcaaaccctccattttaattccgagattgagacgatcctcggcatgggattatttctggcggaagtctatatctggatcatgctgctgctgaactatttgcagaccatctggccgctgaagcgcgaaattgtgcccttgccggaggatatgaaccagtggccgaccgttgacgtttatatcccgacctataacgaatccctcgacgtggtgcgcgacaccgtgctggcggcgcagtgcattgattatccgaaagataaaatgaaaatttatattctggatgatggcaagcgccgtgaattcgcggtctttgccgccgatgtcggcgtcggctatatcacgcgtaatgagcactcgcacgcgaaagcgggcaacctgaaccacgccatgaaactgacccacggcgagctgatcaccgtcttcgactgcgaccacgtggcaacgcgtattttcctgcaggcgacggtgggcggttttctcacggatccgaaactggcgctggtacagacgccgcactatttctattcgccggatcccttcgagcgtaacctttccgtcggccgcaatattcctaacgaaggccagctgttctacggcccgatccagcagggtaacgataactggaacgccacctttttctgcggctcctgtgcggtgatccgccgtagcgcgctggaagagattggcggcttcgctgtggaaaccgtcaccgaggatgcgcataccgcgctgaaaatgcagcgtctgggctggaaatccgcttttctggatattccactggcggcggggctggcgaccgagcgtctggtgctgcacgttattcagcgcacccgctgggcgcgtggcatgacgcagatcttccgtgtcgataacccgctgttcggccgcggcctgaccattcagcaacgtctgtgttatctcagcgcgatgatgtattaccagttcgccctgccgcgcattgcgtttctgaccgcgccgctggcgtatctgctgtttaacctcaacatcatttactcctccgcaagcctggtttttgcctatgcgctgccgcacctgttcctcgcgatttatctcaactcgcggatgaacggtcgtcaccgctacagcttctggggcgaaatttatgacctggtgctggccttccatctggtactgccgacggcggtcaccatgctgtttccgaaacgcggcaagtttaacgttaccgataaaggcgcgctgctgaacgtcggctactttgatttccgggtcgtgcgcccgcatctggtggtggcgatcctgctcgccattgcggtgatctggggcctggtgcgcgctttcgcccatgaccattttggcgtcgatcctaaggttatcgctctcaacgtgttctggggactctacagcctgatcttcctgctggcggctattgccgtggcgcgggaaacccgtcagacgcggaaaaccatccgtatcgatgtgaagatcccggtattgatccattacgccagcggtatctcgtcgcgcagcgaaaccctcgatctgtcgatgggcggctgccgtatcgtcgcgccggatgaacgccatttaaatgatgaaatcgaagaagtggagctgttattacagtccggtgccatcagcattccggtgaccaccatgggcgtggacggtgaatttattcgcctgaagtttgcggaagatattccgctctcacgtcgccgtgaactggtacgggtggtgctgtcccgcgctgatgcgtggatcaacccgccgaagccgcaggacaacccgttccgctcgatgctcaccatcatgcgctgtgtgttcgacctgttctggctgacgtggaaaacgcgccgtgaaaaccggcgtcagcgtgctctcctcaacgcctcaccggaggacggcagcctatgaaacgtttaacccggctggcgattatcgtcagcgcactctttatcacgccgctttacgcggaagaaacgctgccggacactctgctgccgtcggatttccccgcgcctgtggtggatactgccccggctgcgcccccggcctttgtgccgacggtggtgacttccctttccgtggcgcaaatgggccagccgcagggcatcgtactgagcggcggccagttgcagggcggggtgaacttcaccctgccggtcggtcaggttatgactaacgcccagctgtcgctgaacctgaaagtctcacccgccatggcgacccgcaacgccaccatgcagctgatgcttaacggccagccgctgggcacggtgccgctgggcgcggcggaatccgatgtctcgcgctttcagctggatgttccggcggcgctgatggtctccagcaataccatcagtttcaaaattaatgatggcgacgccatgatgtgccagcgggatctgacggataaataccgcgtcaccatcctgcctgactcggcgtttaacctcgaagggcagccgctggatattggatcggatctgagccacttcccgcgtccattcttcgacaacatgcagatgacgcccgccactatcacttttgcgttcccggcgaagctgacggcagataccatcagcgcggcggcgctggtgtcatcgtggatgggtattcaggcggactatcgcggcgtctcttttgccgcgcaacgcgatcgcctgccggaacagaacggcattctgatagggcatcccggtgagcagatcggcggcgtttcgctgccgcagtcggctcagccgaccctgaccattatcgataatccggcgaatccgacctacaagctgctgctggtggtggggaaagacgacgccgcgctgcgtgcggcggcctggcgtctgacgcgcggcaattttgatctgcaaaccgccagcctgccggtggaaccccagacgatcccgcagagcaaagcttacgacgcgccgcgctggatccctaccgatcgtccggtgaagctgtcagagctgatccgtaaagatcagagcctgaccgttaacggtatctggcatgacgccctgcgcgtcgccttccgcgccgcgccggatctgttcctgtgggatggcgaaaccattccgctgcgcatcggctaccgtttcccgtcggaaaactggatcgatgaagagcgctcgtggctgagtatgacgctgaatgacactttcctgcacaacctgccggttaacaagcagggcgcgctggaaaccctgtggcataagattggcggcgatgcgcgtcaggaacagttcgacatgccgctggagccgtacatgatttatggcgataaccagttgtcgctctatttcaatatcgtgccgaaggccagcgcgccgtgcagcgtgctgctgaacaacaacatcaagagccgcatcgacgatgactcctggatcgatttgagccacacgcgccacttcgcgctgttgccgaatctctcttatttcgtgggcgcatctttcccgttcacgcgactggcggactacgccgagacggtgctgctgctgccggaaaatccgaccgaaacccaggtggcgacgctgctggacatggccgcccgttccggtaacgccaccggtacggcgctgagccagaaccgcgtggtactggggatgccgacggcgggtactaatctgcaactgctgcgcgatcgcgacgtgctggcggtgaccggccttagtcagcatgacttcaatgctgaactgctgaagtcctcgccctttgtcgcccatgacaatcagctcagcgtccgcgagccgacgcagtgggaaaaaatccagcgctggatggcgggcgactggaacgccgagatcgtggaagccgatcgttacttctcctcgaacgaatcctggcgcggctttgtcagcttccgttcgccctggaacagtgaacgcacagtggtgacggcgctgggcagcaatgacgagcagcttgcccgtctgcacggcgatctggcctccgcccgcatcaacgccgggatccgcggcgatgccgcgatcattaccaatgaaaacggcgtgcgcagtttccgcgttggcccgcagtatccgcgcggtgaaatgccgctgcacctgctggtgatctggtatgccaaccagcactccggcctgctggcggtgcttggcctgtgctttagcgtggtgatcggcctcgcgctgtacgcgctgctaaaaagacgcgcgcgtaaacgtctgaatcctggggacaacgagtgaaaataatgaccataaaaaccgcccgcacgttatccaccctctgtgtttcgggcgtactggcgctggcaacggcggggatagcgcaggccgcgcccaatgacgcggtgctgaaggccttattcgaccaggccaattactggcatgaaaagtctcacgacgatctggcgaacgaatcgctgaagaaagtgttgatggtggatgccaataacacccaggcgctgtacctgatggcgctgtgggcgcagcagggcggcgatctgaaagcggccgcgcagtggcgcgcccggctggcggccgtatcgccggacgacagcgggctacaggcgctggataacgccaaacagctgtcgcaggtgccgcagggacaactgacgctggcccgccagcaggcgcgcagcggcaatattcccgccgcgctcgccacctggcgcagcctgtttaacggcgatacgccgccgcccagtctcgccccggaatactatctgaccatgggaagcgacaaagccatgtatccgcaggcgctcagtgagatccagcgattcgtggcgcaaaacccgcaggataacgccgcccgcgtggcgctgggcaaaatgctgacgtggcgcgaagagacgcgccgcgacggcatcatgcagcttgagcagatggcgagcggcaacaaagaggcggacgatggcctgcgtcaggcgctgctgtggctggggccgcaggcaggggatgaacagttttacgataactacctgcaacgccatccgaaggacagcgacgtacaggcgtattaccgcaaaagcatcggcggcgcggcgaaaggcgagggctataacgcgctgaacagcggcaacaccagcgatgcccgccgccagtttgagcaggtgctgcaaaccaacccggaagacgcggatgcgctggcggggctggggtatatcgcccagcgttccggcgactatcaggccgcggcgcaatatcttagccgcgcggccagccaggggggcgaggcctctgccgaacgtaaagctcaggctgaagatgccgccttctatggtcaactggcccaggcgcagcaggcgctgaaagagggcaacgtcagccaggcgctggcgttatccgcgccgctggcgcagcaaagcggcgagcgcggcacggcggcgaagctgttccgcgccgatgtgttgcgtcacaacaaagattatccgcaggcggagcagacgctgcgcgaggtgctgaacgatcagcctcagaatgccgccgcgcgggaaaacctctattacgtgctgcgcgatcagaataaagctgaagaagcgcagaccgtattacgcacgctgcccgccggtttacaggcgaaactgcaaccgcgcgtggtcaccggcttgccgggcgatccgatccgtcgtcaggcgcaacagctggcggcgagcggtaacaccagccaggcgattgccgtgctgcaacagggcgtcgcccgtctgccggacgatccctggctgcgtctcgatttagcgcgcctgctgcaaaaaaacggcaatgacagcgaagccagctcggtgatcgccccggcctctcgccctggcgcgggagccagttcgctgtatgcggcggcgctgtttgccagtgaaaacggtgcctggcaacaggcgcaaacgctgttgtcgcgtatttctccggccagtcagaacgggcagatgcgcgatctggcgaaacgggtgaactacaacctgcaaatggcgaccgccgggcgctatctggcgcagggtaatactcttgccgccgccaacacgctgaaaaccctgaccgccacgccgcctgaaagcccggtggatgcgggtaaactggcgcgtctgctggcgcaaagcggcgatctgactggcgcggtagcgctggtgcgggaaaacatgcgcgcgggggtgcagggcaacgccggggattatgccgatcagatcgccgtgctgaacaaggcgggcctgaacagcgaagcccagagtttcctggcccgtccggagattcaggcgcgcagcacgccgacgcaactggcaggcttacgcaccggttatgtcatcaatgaagccgatgcgctgcgcgagcagggtaactatgcggcggcctatgacaagctgatgcgcgccctgcaaagcgatccgcagaataccgatctgatgttcgccatgggccgtctctaccagaccggcaaaatgaacaaagaggccggggtggtctatgactacctgatgacccgcgacaccgacagccaggatgcgcgcgtcggtgcgattgacgtggcgctggcggaaaataatgtcgaaaaagccgactcgctggcccgcggtctgcgggcggataactctgccgaccggatgttgctgctggcccgtctggaagaggcgaagggcaaccatcagcaggccatgacttatctgcgcagcgcgcgcggcaagctggtgggcctggatgcgtcaaacggcgcggcgacgccgaccattggcggcgtgctggtggcggataaccccttcgtgcgcaccagtacctccgcggggcagacggcgtccgcatcggtttacggccagacgctgccgtggcaggtagcgcaggtggcaggtgaacctggcagtacgctgccgggcaccacccgcaccgatctgcctgtggaaaccgcccaggcgcgtacgctgcgtcaggtggatgacatgatgcagagcatggagcagaaaaccggcatgtggatgcagggcggcgtggaagtgcgtggacgcgatggcgaatccggcaccagcaagctgaccgaagccaaagcgccgttaacctggtccagctcgccctttggcgagtcgcgctttgagttcaccgccacgccaatcaccctgagcgcaggcagcgcctcgggcgacacctggcggcgctatggcactaaccctattgataatgccatcagcaatatctcctcatccattgagaatgcgcagaactccgtcgatccgacggcggcagccttcgccgatttgcagggctacaatgcggaaaatctctccccgctgaccgacactggccttgccaatctgaacagccttaatgaatccggtcgcctgaaggcgctcagcgtatcgaacttcaaatccagcctggataacaagataacctcctctaccgactcgcagaaagcgagcggcgtcgagctggcgatggcgctgagcggcgaaagttaccgactggatattggcaccacgccgctgggccaggatctcagtacgctggtgggcggcgtacagtggtcgccgaagctgaccgattatctgacgctgatcatcaaaggcgaacgccgcgcggtcaccgacagcctgctctcctatgtcggcatgaaagacgcctattcgggtaaaacctgggggcgggtgacgaaaaacggcggtaacgtacagcttggctatgatgacggcgacgcgggcttttatgtcggcggcggcggttacagttatctcggcgaaaacgtggccagcaacaccagcatgaacgccagcgccggggtgtatctgcgtccgttccacgacgattaccgccagctacaaaccggcctgaacgtcagctggatggatttctcgaaaaacctcagctactacacctacgggcagggcggctatttcagcccgcagaactacgtcagcgtctctttaccggttgattttagccagaaaatcaacaactggaagctcagccttggcggatctgtaggctatcagtcctatacccaggacagcagcgactacttcccgaccgatgccggggcgcaggggctgatgaaagagctttatgacctgggctacgcgcgtgattatcgctataaaggcggatcggaaagcggcatcggctacaccatgcgcgcgggcgtggattacaacgtgaataaaagcatgaccgtcggcgggaaagtcggctatgacaccttcggcaactataacgaaagcaccgccggactctatttccgctatttgttaggagacaaataaccatgacagtgaacagtcaacacgcgccgctgatcggctggtttcagcagcaacaaacgccgccgggctggtttgatctgctgaccattatgatcgacggtatggtgcgtaatgtcgggcaggtggagagccagccgttcctgcggcagatgggcgaaaccctggcggcgcagttcccgttgccgcccgctgaaaccgtcggcgaactggaggcgcatatcaatgcgcagctgcgtcattttggctggggatttatcgatattgaggccagcgacaccggcctgacgctgcgccatcaggcgatgccgatctcccgccacgaggagcagcaaacgcgctggtgccatgctttttgtgcaatacttgaaggtctttacgccagctggcttcagggccagggcggcgaggcgcatgttgcgttgcaacgcgaacgactgaattcactgtcagacgttctgttccgttatcacaacccacaatgagttgaactatggtcaagcgcgtatctaccgcgatagtcatgacggtgagtctgttatttaccgtatgcgcccaggcaggccctgcctgggacacctataaatcccggtttctgatgccggacggacgtattgtcgataccggcaataacaacgtttctcataccgaaggccagggctacgcgatgctgatggcggtcgccagcaatgaccgcgccagctttgacaagatctgggcctggacgaacaagacgctgaagaacaaggaaaacggcctgttctactggcgctataacccggtagagcctgatccccttgcggataaaaacaacgcctctgatggcgatgccttgatcgcctgggcgctgctgaaggctgacgcgcgctggcacgatgcgcgctataccgcggcgtcggatgccatcactaaggccattgtcgcgcatacggtgattaatttcgcgggctatcgcgtgatgctgcctggcgcgcagggctttaaccacaatagcgatgtgaccctgaatccgtcctattttattttcccggcatggcaggcgttcgctgagcgtagccatctcgtcgtctggcgtgagctgatccgcgatgcgaacacgctgaccgcgaaaatggcctggggggagtcgaagctgccggttgactgggtcacactgcatgccgacggcaaaatgcagcctgccagcaaatggccgccgcgcatgagctacgatgcgatccgcattccgctgtatgtggcctggcagaacccgcaaagcccgctgctaacgccgtggcgcaactggttcgggcagttcagcggcgataaaaacccggcctgggtgaacgtcatgaccaacgaaaccgcgccctataatatgagcggcggcttactggccgtgcgggatttagcgcttggggtgaagcacggcgaaccgcagatcgacgcgcaggaagattactattcggcaagcctgaaaatgctggtgtggctggcagagcaggagtgatttctcccctcaccccgtccggttttcaccggcacggggtgaagggaattcttatcactgcggatacggtacccagtccccgccgttcagccgtacgtacggcttatcctgatactggatcacaatcgcgttcgagttttccgataccggcgctgtctgcggcaggttgctggtcagttgatcccagttcacgctgtcttccacgaacagtttgccgtccaccgcacgaacgaccagttcagatatcgcgaggaagctgctcggctgatcgatgatcaacggagcgccctgatgcggggctttcataccgaagaacttaatgccgaccggcacgttggtgatcgacgggctcgggatgtcgcgcagaccggagacctgcattttatccccctgcaatgcgccgccgtgttccggggccatcaccaccatcaccttacgacctgatttttccagctgagtgaaaaacgcatccagttcatcaaagagtttctgggcgcgcactttatagtcagcggttttactgacgccagggaaatggttgccatcatgcagcggcagcaggttgaagtaagtggcggtgcgctgattgtttttaccttcttcagactccatccagcggttaagcactgccgtatcgtcatataccggcgaaccgtcgaacgacagcagcgcggtcggcagtccggcctgattcatcagcggcgcctgcatgccgccgttttcgcgcacttctttcaggaagccgccaaacacgccgttatgatcgagcataaactgcgatgagaagcccagtttcgccaggttatcgaacagatagcactcgttacccgcctgctgataaagatttttatgcgacggctgaccacagctggcgcgcagcaaacggatggccgccgggccgctgtaagaggtggcggagttaaagtgcttaaactgaatatcgaagtgcgaccacagcggatgcgacatcagtccggcggcttccacatccgcccaggagagggaacagatgttgatcaccagcagctcaaacggctgggcatcggcgggcagcgaggcggggaacggcgttttacgcttctcctcagcctgataaaaactgttcagccaggcatcaagattcgctgtagtcggtggcgctgtctgggcgggcataccgtcgacgaccggcttgttgcctgcgttggcgaccgtcgccgccgcattgccgccggtggtggtgaccgtggtggtcggctgacccgcaggccacagggaaaacgccgggccggtgagggtgatcaggttcagccagatcatgatggccaccacaaataccgtcacgcggatccactgcgccaggaacaaccatgccaccagcagtacaaagatcgcgccaagcatctgccagttgataaaacgcgtgaccaggtccagcagataatcggcgctgaatcccgccacctggctgccctggctcatcatactttgcggacccggcagccaggtatcgtgccagaacagcgcaaagccgataggaatggcgatccagtggcgcagtcgatgcagtttgcgttttggcagcggcatcagcaaaaacgccataaacaccagattttgcagcgcatggaaattaagatagcccgcccataacaggccgaacttcactaaaaaatagaagttccagccagaaagcccgcgccagtattgccacagcggcgacggcgcagagggagtataagattgattagtcatgttttcggtctgctttgacggtggatgcccggcgtaacgttccggcgggtttgacatatttcggcttaacaaacattagccggagtacggttctgatgcggcgcgacgaatgccgcgcggcgtaacccagcggaaagaaaatcagcgcgcacagcaccactaactgaataatatcgctgagagtcatcatgatgagcgctccgtcgtctcactgagcaggcggagaggttgaggaatacgccgccagctgcggccgtcgtgctccgcattcaggatcggattcgggccgtcggtcaccggcagcgggcgtgaccacttctccggttgcagcgtgcgcatgttcaccagttccgcggaaatctggttatcctcaaaccacaccatgcggttagaaaaaatatcggcgatgggcagcgggaaaatatggttgagcgcggtatcgagatcgttgacccggcagaaggataaaaacagcaccagccggttatcgccgatggtcataatgtccccgacgcggttcgggcggcacagcgtcagcgcctgctcgacgcggatccccggcaccggacgcagcgccaccagcacgcctttgccatccggcggcagtaatgtgttctgcatcatattgccgacggcatcgcagaaaatatcccacgtctggaaaccgcgcagcttcagcggctgcgtcatggtcaggagcgtggcgatctcctccggcacgtggcggttaaattgctggccctgcacgctttcaatcagcgtcagacagcgtgacaggggcgcattccacgggatcaccatattcgcgccgcagcctaataacaggcgttcatcggtggcgcgcaggctggcggtgttttcacgcacgatgattttcaacgcgctgccgcgctggcggcgcagcgagtggatctgccgcgcgaggttttcaatctgattattttgcgtgagcgagaaaatgaccgtcgcggcctgggtggtacgcgcttcttcaaacagcgcttcgttattatcgaacagcgtccagtattccgagagcggcggcgcgccttccagcagggcgacattacttaaaatgcgtttttcgtcgctgcgcggctgtacggtgggttcttcctggcgggctaattgccagccgtcgccgcgtggctccagaataagctgctggcgcgcgctgacgcctttttcgttacaccagaaggcaacgtcatacagatgaatatcctgctggctgcgcaaactggcgaggccatataatgagcgatattccgtcgtcagaaaggagaacagtttatcattattgttcccggggttaacgatcagcagcgtacaattgtggtatttcgaccacctatgaatattctcaagccatacacgtaatttatcattggatatattctgccaggcattactggcacacagcaggataaataaatggtgatgaggatcgaccgaacagagtaaatcaggggcaagcgagtatagactattttctttatccggcatgaaaaacagcctaattttttccggaccgtgatgctcgtccagtttgatgatattcttcggctccttgcccatgctgatcaccgcaaccttgctggcaccgggctgcgcggcaacggtctgattaaccagccttaccgcatcgtcgtcgcggtcagcgttgatccaccagacccctccggcaggcatatggcgcaattcgtcccacaaggagtgaatgccaatagaaaatatggggtccatcgcgtccctcttgttgcagatcgtcagttatctcagtttactagcgaaagcaaagaaataaacctaacattgaaattaaagagcatcagatttagcatgtaaacacatttttttcgccgggcaagtggataaattctttccagcagttttttattcaaaacgataggataaaaaatgaataataatgaaaccgctaattcgaaagattcaagcctgaactatacctggcagaatgattttctggcactcagtcgggtgttttcattgcctgaaatagattacaccgacatttctcaacgggaacaattggcggcagcgattaaacgctggccattgctcgctgaattctcccaactgccataaggaagccggaatggccattctgggattacagggcatacgcggcggcgtgggtacgacctccgtcaccgctgcgctgggctggtcactgcacatgcttggcgaagcggtgctgatcgttgatgcctgcccggataatctgctgcgcctgtcatttaacgtcgactttacccagcccgcaggctgggcgcgcgcgttgctggacgggcaggactggcgcgacgccgggcaacgttacacctcgcaactggatctgctgcccttcggccagctcaccgcaggcgaggcggaaaacgcgcacctgctgcatgacgcgttaagcggcatcgggccgatcctgcaaagcctgaaagcgcaaagccattatcagtggatcctcgtggatctgccccatggtcagacgccgctgacgcgcctgatcctcgaacagtgcgatcgggtgctgaccctcgtcaggccggataccaattgccacgtgcgtttacatcagcaggcgttgccggcggggacgcacattctgcttaacgatctgcgtatcggcagccagttgcaggacgatctgtatcaggtatggctgcaaacccagcgccacctgttgccgacggttattcaccgcgacgaggcgatggccgaatgtctggcggcgaaacagccgctgggagagtaccgcagcgactcgctggccgccgaagagatcatgacgctggcgaactggtgtctgctgcacgccgcgcaacctgccagcgggagtgacgcatgagccgtctttccacctggtttttgatccccccggttagcgaacgcctcggcgcgcgctaccagctttatcgcagccacggcgcgccagcgttcagcgccgccctgggctgcctgtgggcgatcctggcctggctttttctgccgctggaaaatccgcgctggcagtcgatccgcgaacgccaccgcgagctttacccgcatattcgcgccgaacggccgcgcccgctcgatccggcgcgttacctgctgcaaaccctgtggctgatggttacgcccgaacaggcaacggcaggcgcgccgcgcaaacgccgtcgcgcaggcttctcgcaattaatggcccgctaccatgcgtggctcgacgcgctgccgcagcgcttcagcgcccggaccagccatctggataatcagaaagaactggcgcacctgcatccgcgtctgcggcgcattattcttggtgtgatcgtggccttttccgccattctggcgctgctgtgcatcacccagccgtttaacccgatgtcgcagttcatcttcctggttctgctgtgggccgtggcaatgatggtgcggcgtatccccggacgcttctcggcgctgatgcttatcgtattgtcgctgaccgtttcctgtcgctacatctggtggcgttatacctccacgctcaactggaacgatccggtcagcctggtctgcggcctgatcctactgattgccgaaacctacgcctgggtggtgctggtgctcggctatttccaggtggtgtggccgctcaatcgtcagccggtgccgctgccgaaggatatgtctctgtggccgaccgttgatattttcgtcccgacctacaacgaagatttgaacgtggtgaaaaacaccatttatgcctcgctgggcatcgactggccgaaggataagctgactatctggatcctcgatgacggcgggcgtgaaaccttccgccagtttgccgagaccgtaggggtgaaatacatcgcccgtaccacccatgagcacgccaaagccgggaacatcaacaacgccctgaaatatgcgaagggcgagtttgtatcgattttcgactgcgaccacgtgcccacgcgctcgtttttgcagatgaccatgggctggttcctgaaagagaaagagctggcgatgatgcagacgccgcaccactttttctcgccggatccctttgagcgcaaccttggccgcttccgtaaaacccctaacgaaggcacgctgttttacggtctggtgcaggacggcaacgacatgtgggacgcgacctttttctgcggttcctgtgcggtgatccgtcgcgggccgctcgatcagattggcggcatcgcagtggagacggtgacggaagatgcgcacacttctctgcgtttacaccgtctcggctacagctcggcctatatgcgtattccgcaggcggcgggcctggcgacggaaagcctctcggcgcatatcggacagcgcatccgctgggcgcgcggcatggtgcagatcttccgcctcgataacccgctgttgggcaaggggctgaagctcccgcaacggctctgttatgtgaacgccatgttccacttcttatccggtattccgcggctggtgttcctcaccgcgccgctggcgttcctgttgctccacgcctatatcatttacgccccggcgctgatgatcgcgctctttgtggtgccgcatatgatccacgccagcctgaccaactccaaaatccagggcaaatatcgccactcgttctggagtgaaatttacgaaacggtgctggcctggtatatcgccccgccgaccatggtggcgctgtttgcgccgcataaaggtaaatttaacgtcaccgccaaaggtgggctggtggaggaggagtacgtcgactgggtcatttcccggccctacattttcctcgtgctgctgaatatcctcggtatcctggtgggcgtctggcgctatttctatgggccggagaatgaaattcttaccgtattcgtcagtatcgcctgggtgttctacaacctgatcgtgctcggcggcgcggtggcggtgtcggtggaaagtaaacagttacgccgcgctcatcgcgtggaaatctcgatgccagcggccatcgcccgtgaagatggccatatgttctcctgtaccgtacacgacttctctgacggcgggctgggcatcaaaattaacggccaggcgcaggtgctggaagggcagaaggtgaacctgctgctcaaacgcggccagcaggagtatgtcttcccggcgcaggtggcgcgcgtttccggtaatgaaatcggtctgcaactgatgccgttgaccacccgtcaacatattgattttgtacagtgtacctttgcccgcgccgatacctgggcactctggcaggacagcttcccggaagataaaccgctggaaagtttgatggatattctcaagctgggtttccgtggctatcgccaccttgcagaatttgcaccttcgtccgtaaaaatgattttccggtccctcacttcactggtttcctggcttgtgtcgttcgttccgcgccgccccgagcgggacgtggtagtacagcaaccgggttcgtgactggctcaacaatgatgataatgcgatgaaaagaaaactttcctggatgtgcgcagtggtaatgggattaagtgcatacccctatgcaatgacgatggcggcgcctgccagtccggcggctacggctgcgcccgtggtgccgacggtaacgcctgcaacacaaggggccgccacgccggcgccgacgcagccggaatccatgatgcccgtgacgccggtcgaagcacagaccaccccggtgggtcaggtcatgccgggcgtaaacggggcaaatgcgccgattgtcgccgataatgcgccaacccgcgacgttaccctgacttttgcgcagatcgcgccgccgccgggcagcatgatcctgcgcggcgtcaatccggacggcggcattgaattcggaatgcgcagcgacgaagtggtgtcgaaagcggtgctgaatctggaatacacgccatcgccgtcattgctgcccgtgcagtcgcagctgaaggtctatctgaatgatgagctgatgggcgttttgccggtcaccaaagaacagctgggtaaaaagacgcaggcgcaggtcgccgtcgatccgctctatatcaccgattttaaccgtgtgcggctggagtttgtcggccattaccgcgatgtgtgtgaaaacccggccagcagcaccctgtggatggatatcggccgcaacagttcactggcgatgacctaccagaagctgacgctgaaaaatgacttgtcctctttcccggtgcccttcttcgatccgcgcgacaaccgtccgctgaacctgccgatggtcttcgctggcgtcccggcgctggcgcagcaacaggcggcgagtattgtcgcatcatggttcggcacccgcaccggctggcgcggccagcagttcccggtctcttatgacgcgctgccggacagcaatgccattgtcttcgccaccaacgacaaacgtccggcattcctgcgtgatgtgccgccggtgaccgcgccgaccgtgatgatgatgaaccacccgactaacccgttcatgaaagtgctggtggtgttcgggcgcgatgacaaagacatcctgcaggcggcgaagggcattgcccagggcaacctgctgttccgtggcgaccgcgtggtggtggacgaggtgaaaccgctgctggcgcgtaaaccttacgatgcgcctaactgggtgcgtaccgaccgggcaatcacctttagcgagctgaaaacctatgaggagcagttgcaggccaccggcttacagcccgcctccatcaacgtggcgatgaatctgccgccggatctttatctgttgcgcagcagcggcattgatatgaacctcaattaccgttacaccgcgccaccgacgaaagataactcgcgcatggatatcagcctgaacaaccagttcctgcaatccttcagtctgaccagcagccaggatactaaccgtctgctgctgcggctgccggtgctacagggtctgctggatggtaaaactgaagtgtctattccggcgctgaaactgggcgcgctgaaccagctgcgcttcgacttccagtacatgaacccgatgccgggcggtacgatcgaaaactgtatcaccttccagccggtgcaaaaccgtgtggtgatcggcgacgactccaccattgatttctcgaagtattatcactttatcgccatgccggatctgcgcgcctttgccaatgcgggcttcccgttcagccggatggcggatctctctgatactctggtggtgctgcccgcgcagccaacggcggctcagctcaccacgctgctggattccatgggcggcatcggagcgcaaaccggtttcccggcggtgaacgtcaccctgaccaacgatggtaatcagctggcgaataaagatgccgatatcctgatcatcggcaccttaccggaaaaactgaaaaacgatgaacgtatcgacttgctggtgcaggccacgcaaagctgggtgaaaacgccgcagcgccagacagacttcccggccattgtgccggacgtcaatgaccgccaggccgacacgcagactgccgtcagctccagcggcccgatggcggcgatcgtcggcttccagtcgccctataacgatcagcgcagcgtggtggccctgctggcggacagcccgcgcggctacagcctgctgaacgaggcgatgaacgacagcggcaagcgcgccgccatgtacggctcggtgacggtgatccgcgaatcgggcgtgaacggcctgcgggtgggtgatatctattatgtgggtcatctgccgtggtttgaacgcatctggtatgcgctctcaaaccatccgatcctgctggcggtgctggcggcagtgagcgtcgtgttgctggcctgggtgctgtggcgtctgctgcgcatcatcagccgtcgtcgtcttgatggcgaccatgaataaattgcgataccggggtccgtcatgcgcaggttaacgctacgttttatcgccttatcgctcggcttctcggcgatgccgcttgtgcatgccgcgccggatgcgcaacagcaactgctggaacaggtgcaactgggggaggcgacaaaacgggaagatctggtgcgccagtcgctctaccggctggagctgatcgatccggcaaacccggacgttatcgccgcgcgcttccgttatttgctgcgccagggcgacaccgcgggcgcgcaaaaacagctcgacaggctacaggaactggcgccggactccggcgcgctgcgcgattcccgcaatatcatgacgctctccagcccggaagggcgacaggcgttgcaggaagcgcgtttgcagggcaccaccggccatacccaggaggcgctggctgcttacgataagctgtttaacggccatccgcccaccggcgatattgcgcgggaatactgggtgctggtagcgaaagtccccgcccggcgcaatgaagccatcaatcagttaaaagcgcttaacgcgcggcgtccgggagatggcgagctgcaaaacgccctcgcgcaattgctgtttgccagcaatcgcccggatgaaggctatgcggtacttcagcaaatggcgaaatccggcaccagccgcaatgccgccgccgctatctggtatcagcaaatcaaagatctgcccgtcagcgacgccagcgtacaggcgctgcaacgttttctggcgcagttcagcgagggcgataacgtcgatatggcgcgtcaacagctggccgaacagcagcagaagctggcggatccggcgtttcgcgcccgtgctcaggggctggcggcggtggatgccgggcagggtggcaacgccattgccgctctgcaacaggcggtcagcgccgacgcgagcgacggcgaagccactggcgcgctgggtcaggcatactcccagaaaggcgatcgcgcccgcgcggtagagcagctggaaaaagccattgcgctggcgccgcaaagcagcaaccgcagtaaatgggacagtctgttgcagaccaaccgctactggctgctgatccagcagggggacgcggcgctgaaagcgaataatccggcccaggcgacgcgtttttatcaacaggcgcagcaggtggataacactgacagctacgcggtgctggggctgggcgatgctgcgctggcaagaaaagagactgacagcgccgagcgctactatcagcaggcgctgcggatggacagcgagaacagtaacgcggtacgcgggctggcgaacctttaccgggcgcagtcgcccgagcgcgctgaggcctttattcagacgctgaatgcccgccagcggcgcagcattgacgacattgaacgcagcatgacgggcgaccgtctggcgcagcaggccgaaactctggaaaaccgcagcgactgggcgcaggccgctgaggtgcagcgtcagcgcctggcgctggatccgggcagcgtgtggatcacctaccggctggcgagcgatttgcgtaacgccgggcagcgcgcccagggcgatgcgcagatgcgcgatctggcggcgaaaaaaccgaacgacgccgaacaggtttacgcttatggcctgtatctctccggcaatgaagatcagggcatggcggcgctggcgcatctcaacacgctgccgaaaagccagtggacgcccaatattcaggagctggcggatcgcctgcaacggaatcaactgctggcccgcgctaatcagctgcgcgacagcggcaatgaaccggcagcgatagatctgctgaagtcgcagcccgcgtccacgcccattgatttaaccctggccgactgggcgcaacagcgcggcgattaccctgccgccagcgccttatataacgctgtgctggcaaaagagccggataatctggatgcccgtctgagcctggcggaagtggccgtggcgcagcaaaacccgatggaagcccgcgcgcagctggcgaaaatttccccgtcagccacgcagccattatccatgaataccgagcggcgtatggcgctggttgaggcgcgactggggaatactcgtgaggcgcagcagaccttcgccagactggtgccccaggcaaaatcccagccgccgtcgcaggacagcgcgctggtactacgtgatgccgcccggctttcgcaggcgacgggtgaaccgcagcaggcgctggaaggttataaagatgcgatggtcgccgccgggatcgccgcggcacgtccgcaggataacgacacctttacccgtctgacgcgcagcgatgaaaaagatgactggcttaagcgcggggtgcgcagcgatgcggcagagctgtatcgccagcaggacgtgaacgtcaccctggatcatgattatggccgctcagacgggacgggcggttattccgatctgaaaatgcacaccactatgttgcaggccgacgcgccgttagccgacggacgcatgttcttccgcaccgatgtcatcgatatggatgccggttctttcagcaagaacagcgacggcctgtatgatcctaactggggtacctgcggcgagttgggctgtgacaatatcgataaaaaacagagcgacaggggcgtaagcgtcgcggttggctggcgtaatgacacctgggacatggacatcggcaccacgccgatggggtttaatgtcgttgatgtggtgggcgggctgagttacagcagcgatctggggccagtcggttataccctgaacctgcatcgccgcccgatctccagctcattgctggcctttggcggacagaaggacgccagaggttatcaatacgatccggacgatgaagataataaccggggcggcaccgggaaaacctggggcggcgtgcgggccagcggcggtggcgtcagtatgagttacgatcgcggcgaagcccacggcgtgtgggcgagtctgaatgcggacactctgaacggcaaaaacgtcgaggataactggcgcgtgcgctggatgacgggctattactacaagcttatcaataaagacaatgagcgcatgaccgtcggcctgaacaatatgatctggcattacgacaaagatctgagcggttatacgctgggtcagggcggttattacagcccgcaggagtacgtctcttttgcggtgccggtgacctggcgcaaacgcacggaaaactggtcatgggagctgggcggctcaggctcatggtcccactcacgcaccaaagcgcaggccagttatccgcgcttaaatctcatcccggcagaattccggcaggatgcccgcgatgagggtagcgaaggcggcagcagccagggcttcgggtatacggcccatgcgctggtggaacgccgtatttcatcgaaatggtcaataggcgcaggtattgatattcagcaggcgaaagattatacccccagtcacgggatgatctttgttcgctactccgatgcgggctggcagggcgatatggatatgccgccgcaaccgctgatgccttacgctgactggtaacgggaatctagaattatcttatatcccccggacagtctcttaatgatgccgctatagggtatactctggcggcggtaaggtaacagcaggttacttttcgtgttaagggtattccggagaaacaatttgcgcgtcagccgttcattaaccataaaacaaatggcgatggtgtcagccgtctctatgctgtttgtgttcattttttgcgtcattttgctctttcattttgtgcagcaaaaccgctataacacagccacgcagctggaaagcattgcccgctcggtgcgcgagccactctcatccgccattctgaaaggcgatattgttgacgcggaaaccatcctgaaaggcattcagcctgcgggcgtggtcagccgtgccgacgtagtgctgcccaaccagttccaggcgctgcgcatgcgctttattcctgaacgcccggtgccggtgaccattacccgtttgtttgaactgccggtacagatttccctgcctatttattccctgcaacgcccggcgaatccccagccgctggcgtatctggtgctacaggcggattcgtaccgcatgtataagttcgtaatgagcgcgctgtcgacgtttgtgacggcttacttactgcttacgctgatgatcaccgtggctatcacctggtgtattaaccgtctgatcgttcatccgctgcgccgtatcgctcgtgaacttaacgatctgccccagcatgagttgccagggcatcaactggcgctgccgcgtcatcaccatgatgatgaaatcggcatgctggtgcgcagctataaccgccatcagcagctggccttgccgcatcacgacgacgcgcgctatccggtcgctggatcggcgcataaagcgattcttaccgcactggataatcaccagtacaccatctggctgcaaccgcaggtaaatctggcgaccggtaccctgctgggggcggaagcgctgctgcgcgtgcgccagccggacggcagctggacgctgccggaagggcttatcgagcatatcgaaaataccggtctgatggtgactgtcggttaccgggtgctggaagcggcctgtcgccagctggcggcctggcaggggcgcggtattatgctgccgctgtcggtgaacctttcggcgctgcaactgatgcatcacgcgatggtgccggatctgctggcgctgttaagccgctatcgtattgcgccgggtacgctcatcctggaagtgaccgaaagccgccgtatcgacgatccgcagacggcggtggggattttacgcccgctgcgtaacgccggagtgcgtatcgcgctggatgattttgggatgggctacgcgggcctgcgtcagctgcaccatatgaaatcgttgccggtggatctgttgaaggtggataaaacctttgtggaagggctgccggacgataacagtatggtgtcggcgattatccatatggcgaacagcctggatctggagatcattgccgaaggcgtggaaaccgacgctcagcgcgagtggcttgccgccgctggcgtgaccatggcgcagggatttttattcgcccgcgccatgccgccggacgcctttgaggcgcgctatttttccgcctcgccggaagatgaaaaagaatagtctgttttacacttgtgcgagtcagctcaaatttcttaacattattgtttcaaatttgaagtaagtttatttctgtcatgtttatcgggtgttattttaaagccgcaggcaaacctaaaccctacaaggcctgtggtttttacttcaaggacaccctatgaaaacctcactgtttaaaagcctctattttcaggtcctgaccgccatcgccatcggtattttgctcggccatttttatccggaaatcggcgcgcaaatgaagccctttggcgatgccttcgtaaaactgattaaaatgatcatcgcccccgtcatcttctgtacggtggtcaccggcatcgctggcatggaaagcatgaaggcggttggccgtaccggcgcggtggcgctgctgtacttcgaaatcgtcagcacagtggcgctgattattggcctgattatcgttaacgtggtacagcctggcgcgggcatgaacgtcgatccggcgtcccttgatgctaaagcggtggcggtctatgccgaacaggcgcagcagcagggcatcatccccttccttcttgatattattcccggcagcgttataggcgcgttcgccagcggcaatatcctccaggtgctgctgttcgcagtgctgtttggttttgcgctgcaccgtctgggccacaaaggccagctgattttcaacgtgatcgaaagcttctcgcaggtcattttcggcatcatcaatatgatcatgcgtctggcccccattggcgcctttggcgcgatggcctttaccatcggtaaatacggggtcggtacgctggtgcagctgggccagctcatcgcctgcttctatatcacctgtatcctgtttgtggtggtggtgctcggctctattgcccgcgccacgggcttcagcattttcaaatttatccgttatatccgcgaagaactgctgatcgtgctcggcacctcgtcgtcagaatcggtgctgccgcgtatgctggataaaatggaaaagctgggctgcaaaaagtcggtggtggggctggttatcccgacgggctattcctttaacctcgacggcacctctatttatctgaccatggcggcggtatttatcgcccaggcgacgaacagccatatggatattttccatcagatcaccctgctggtggtgctgctgctgtcgtcgaaaggcgcggcgggagtcacgggcagcggctttatcgtgctggcggcaaccatttcggcggtcgggcatttaccggtagccgggctggcgttgatcctcggcatcgaccgctttatgtctgaagcccgtgcgctgaccaacctggtgggtaacggcgtggccactgtggtggtggcaaaatgggttaaacagcttgatgaaaaacagctgacggatgtgctcaataagcgtgcgccggacggcaaatcgcaaaaaatctcctcataatttcgccacttagacccgtcgtcccttgtggggcggcgggctcctgcgcataattacccaaaatttcacttcccggcgtgacgtttcgctttttacgctgtctaacacgaagtgtttagtcgtcatctcttagactgcccggcaatgaggcggtcatttaaccaggaatgttgatcaggggttcacatgcagggcacaaaaattcgactcttcactggcggcgtgctgatgatggttgccgccagtcatgtgcaggcagatgcgctccagcccgacccggcctggcaacagggaacgctggcaaacggttttcagtggcaggtgttgtccacgccccagcgccccagcgatcgtatcgaaattcgcctgttaattaataccggctcccttactgaaagcacccagcagagcggcttcagccattttattccccgtattgcgctgacgcacagcggcggccttgagcctgcccaggcgcgttcgctatggcagcagggcatcgatcccaaacgcccgctaccgcccgcgatagtttcttacgaatacacgatgtttaacctgagcctgccgaataaccgtaacgatctgctgaaagagtcgctggcttatctggcagataccgcaggcaaactcaccatcaccccggaaaccgtaaaccacgctctcgccagccaggacatggtggcgacctggccgcaggatacgaaagacagctggtggcgttaccgtctgaagggctcgtctttgctgggccacgatcccgccgacccgctcaggcagccggtggataccgaacaggtgaagtcgttctaccagaagtggtacaccccggatgccatgacgctgatcgtggtgggcaatatcgacagccgcgccgtttccgaacaaatcaacaaaaccttcggcgagctgaagggcaagcgcagtaccccggcgccggtgccgaccttatcgccgttaccgcgtgaatccgtaagcattatgagcgacgcggtgcgccaggatcgactctccattatgtgggacaccgcctggcagccaatccgcgaatccgccgtgctgttacgctactggcgcgccgatctagcccgcgaagccttgttctggcatgtgcagcagacgctcagcaaaaacaacgctaaagacattggcctcggctttgactgccgggtactgttccagcgcgcccagtgcgcgatcaacgtcgaatccccgaatgacaagctgaacagcaatcttggcgctatcgcccgggagctggcgaaagtgcgcgataacggcctggcgcaggaagagttcaacgcgctggtggcgcagaagaatctggagctgcaaaaactgttcgcgacctatgcccgcaccgataccgatgtgctgatcagccagcgtatgcgttcgctgcaaaatcaggtggtggatatcgcgccggaacagtatcagaagctgcgtcaggatttcctgaacagcctgacgctggaaatgctgaatcaggatctgcgccagcagttatcacaggaaatggcattgatactgctgcaacctaagggtgagcaggaggtcaatatgaaggatttgcaggccacctgggaaaacattatgtctcccgccacccatgcgcctgtcccggtgaatgacgatacgcatcaggacgtgtcggatattccgccggcccagcgttagaaataaccctctccccaggggagaggggatttatttttactgcggcatcgcctcgcgcggaataatcgcgccgcgatactggatcaccgtactggccgtcagatgcccgcgtctggcggcagcttccgcatcgccgcccgtcagacgcaccgccagatagcctgcgctgaacgaatcgcccgccgcggtggtatcaatcactttctcttttggcagtttcaccgccggtacatcaatcaccgcttctccggcgaccgacaccaggcaggactctgcacctcgtttcaccaccacttccgtcacacccgccgcatgggtacgggcgatgacgtcttcaaccggctgctgtccccacagggcgtcttcatcatccagcgtcaggaaggcgatgtcggtgcactccagcatctgctggtacacctgctgcgtctcttctttgctggcccacaggcgcggacgatagttgttatcgaaaatcactttaccgccgttggcgcggcattcacgcagcaacgacagcagtttgtcacggctggccgggcttaagatggcaaggctgataccgctcagatacaggtaatcaaaggttgccagctcttcgcagatggcggcagactgttcgctttccagccagaattttgccgccgcttcgttacgccagtaatagaaggtgcgttcgccggtgctgtcggtttcgatgtaataaagacccggcaggcggttttccatgcgctgcgtcagatccgtatccaccttttcactctgccaggcgtccagcatctgctggctgaaattgtccgtgccgagggcggtaacgtagtgcaccgtcagcgcttccggagcgacctggcgggcgatataaaccgaagtatttaaggtatcgccaccaaagccacggttaacttcggagcctttttgtgacagttcaatcatgcattcgccaatgacggcaattttcctggacatagtcgtaacctgaatcggagtgatggacagtagtttgcgttgcgggtgtttcatggtcaatcatattaaaacaacgttccataaattttttgagctggcgcgtataacgtgcagattctgctgcctgattttccatattgccttttaagtgaacataaagttctgtccctccccgccgataactcaaggacgagttccgacaggccactcactcaatcaacaggacagactgataatgaagttaaagcaggttatccagcggctaaacattccggaggcgagcattgaaagcttgcaggagcgacggtactggttgcagtgcgaacgtgcttatacttatcagccgatctacaaaaccgatggccatctgatggcgattgaggtcctgaccatcgtcacgcatccatccgatcccacacaacgcattgcgcccgatcgttacttcgcggaagtggcggtgcgtcagcgtgttgacgtggtggaggagcagatcacgctgctcgcccgtcagcatgatttttttatgcggcacggcattctggcatcggtgaacgtcgacgggccgacgctgctggcgatgcgccagcatgaatcgttgatcgatctgattaacacgctgccgtggctgcgtttcgagctggtggagcatatccgcctgccggatgacgtctcctttgcggcaatctgtgagatttgcccgctgtggctggatgatttcggcaccggcatggccaacttctcggcgctgagcgaagtgcgttacgactacattaaagtcgcccgcgatctgttcatcatgctgcgtcagaccccggaaggccgcaatctgttcacgcagttgctgcaactgatgaaccactattgtcagggcgtgatcgtggaaggtattgaaacgctggaagagtggcgcgacgtacaggcctcccctgcggcagcggcgcagggctatttcctctcccgtccggttccactggaaaatctgcatcgtgtgatcctggccctgtgatgctggcggtaatatcccgctgattacgcagtcattctgccctttttgtcagcctcagctatctttaaaagaggcaggaaaagacaggaaggaagcaggaatgactaaaacaggcaaaattataaccgccgtcattggaaccctcgtattgttgatcgtcattgcgatcatcgtcattgcgacatttgactggaaccggctcaagcccaccattaacgaaaaagtctcaaccgagctgaaccgtccctttgccattcgcggcgatcttggcgtggtgtgggagcgccagaaacaggaaaccggctggcgcagctggatcccctggccgcatgtgcacgcggaagacgtggtactcggcaaccctcctgatattcctgctgtcaccatggtgcatttgccgcgcgttgaagcgacgctcgcgccgctggcgctgctcaccaagaccgtttacctgccgtggatcaaattccagcagccggacgcgaggctgatccgcctttcggaaaaaaacaataactggaccttcaatcttgccagcgacgacaagccaaaagatgaaaacgcgcagccatcgtcgtggtcattccagctggacaacattcttttcgatcgtggccgcattgatattgacgataaggtcagccgcgcggacattgagatccttgtcgatccgctgggcaaaccgctgcctttcagtgaagtcaccggatcggataaagacaaaaacgccaaagtcggcgactacgtgttcggcctgaaggccaaaggacgctacaacggacagccgctgaccggcagcggtaagatcggcggtatgctggcgctgaaaagcgaaggcacgccgttcccggtgcaggcggatttccgttccggcaatacccgcgtggcttttgtcggtacggtgagcgatccgatgaaaatgggcggcgtcgatctgaaactgaaattcgccggggattccctgggcgagctgtacgatctcaccggcgtcctgctgccggacaccccgccgtttgaaaccgacggccgtctggtggcaaaaatcgacgctgaaaaaacctcggtttacgattatcgcaactttaatggtcgcatcggcgacagcgacattcacggctcgctgacttacaccaccggcaaaccgcgtccgaaactggaaggcgatctggaatcccgccagctgcgtctggcggatctggggccgctgatcggggttgataccggtaaaggcgcagagcagtcaaaacgctcggaagagaaaaaaggcgagaaaactaaccagccggcgggcaaagtgctgccctatgaccgcttcgaaaccgacaagtgggacgtgatggacgccgatgtgcgcttcaaagggcgtcgcattgagcacggcagttcgctgccattgagcgatctttccacgcatatcatccttaaaaacgccgatctgcgtttgcagccgctgaagttcggcatggcgggcggcaccatcaattccaatatccacctggaaggcgataaaaagccgatgcaggggcgggcggatattcaggcgcgtcgtctgaagctgaaagagctgatgccggatgtggagctgatgcagaaaaccattggcgagatgaacggcgacgcggaattccgcggcaccggcaactccatcgccgcgctgctcggcaccagcaacggtaatctcaagctgctgatgaacgacggcgtcatcagccgtaacctgatggaaattctcgggctgaacgtcggtaactttattgtcgggcagatctttggcgacgacgaagtgcgggtgaactgtgcggcggcgaacatggatctggttaacggcgtggcgcgcccgagtattttcgccttcgatacggaaaacgccattatcaacgttaccggcaccgccagcatggcgtctgaacagctggatctgaccatcaatccggaaagtaagggcatacgtatcgtcacgctgcgatcgccgctgtacgtgcgcggctcgttcaaagatccgcaggcgggcgtgaaggctggtccgctgatcgcccgtggtgcggtcgccgccgcgctggccacgctggtgacgccagccgctgcgctgctggcgctgatctccccgtcggaaggtcaggaaaaccagtgcagtaatattctttcgcagatgaaacgctaagaaagtcccctttcccgccaggggaaggggttattcgcggcacagccattgcgttgcgccctgagtaatgagcgccgattgccgcggcgtcggcggtcggtcgctgaccacaaaatcgaagtctgacagggtgccgttctggcagacggcggtgcggccaaacttactgctgtccaccaccagcacggttaacgccgcgctcgccaccagcgcatgacgcgcggccacctcatcatcgttaaaatcgaacagctcccccgcgtcactgagtccgccaacggataccacgcccatatccacccggtagcggctaaaaaaggccagcgcatcgccgccaatcacatctaaatcacgcttacgaattcgccccccggcaattgtcagcgcgcactgttcccgctgactgagcggcaacgcggcgtgcagattattggtgaacaccgccagacgggaatcagcgggcagcgcatgggccaccatttccaccgttgtgccggtgccaagaaaacagctttgccagcggctcagcagttgcgcagtgcgctcgccgatccagcgcttaccgctaatattcacaatctcccgctgctgataaccaatattttcgcgcgcgaaaggggcgaccacaccgtgacggcgcagcagcaaaccctgcgaggtgagcgtgcgcaaatcgctgcgtaccgtttgcagcgatacgccaaagtagtgggccagctgttcaatgctgatttcgccgcgcccggtgaccagttcaacgatggcagtccggcggatttctggagtcatctcactttccttcaatacgatttcccacaaggttaccgcgccaatatgaaaatattactacgaaaggagatggtcatatttttgtcagattggcctgttttaatcatcacaacgaaaaccgaggggaaacggaaatgagtaaaaaattagcgctggcggccgttgtactggcaacactgagcggacaggcactggcaaaaagcacgctcacgctctacaccagccagccgagtgaagacgcgcaaatgacggtcaatgcgtttgagaaagcgcacccggatattgaagtgaaatggatccgcgacggaaccaccaaactgaccgcgcgcttacaggcggagatggcggcaggcggcgacgcgccggatgtgctgctcatcgctgacagtgtaaccatggaatccctaaagcagcaggatttgctggcggcctatcactccccggaagccagtcgctatgacgcgcagctgtatgataaagcgggcttttactacggcaccaaactcatcactaccggcatcgcttatcacaccaaagcgccagtcaaaccctcatcctggcaggatctgctgaagccggagctgaaaaatatgaccacgctgcccagcccgctttactccggcgcggcgcaaatccatatggccgcattgatgaacaccccgcagctgggctgggcctattacgaaaaactgaaagccaacggcgcgatgccgcagagcggtaacggggcggtgatgagcgccatcacctccggcaacaaagcctacggcgtgctggtggattacatggcgatccgcgagaaagcaaaaggcgcgcctattgatttcgtcttcccgtcggaaggcgtcagcatggtcaccgagccggtggcggtgatgaagagcgccaaaaatccgcaggcggcgcacgcctttattgatttcgttctctccgacgcggggcagcgactggtgctgcaacagggctatctgcctgcggacgcccgcctgccggtacccgccggtttcccgccgcgcgacagcatcaaactgatgccgttcgatgccgccagagcgctggccgacgcggagccgaacaaaaaacgcttcagcgatctgtttggcagcaaataaccgatgagcatcatgacccttcgtcaaccgaccagcagcggcccgccgaaagggctgctgtggttattgctgtgcattgtggcgctgctgagcctgttgcccagcctgcgtctgttaatggccgcgctgctggactggcagcagggcagcaacagcagtttaggccgcgtgctgagcaatccatcgacctggacggcgctctataacagcctctataccagcgggcttggcacgctgttgtcgttgctgctgggcagtctgttcgccttttgtctggcgctgaccaacatccgcctgaaacagatgtgggtgttcctgtttatgctgccgatgatgatcccgccgcaggtgacggcgctcagctggctgcaactctttggccccggcagcattctgctgaacagcattggccttgcgccgtcgttcggcagcccgaatccgctctattccgccgaaggtatcgccctgctgctggggatccagcatgcgcctctggtctttctggcgctgcgcacccagttgcagtgtctgcccaaagagcagatcgaggccgcacggctgaacggcgcgtcgctgtggcgcgtgttcgtcgatattgtgctaccgctgtgccgcaccgcgctgtgggcgggggcggcgattgcctttgtttccgcgctcggcaacttcggcattccggcgatgctcggtattcccatctcgtatttcgtactgccgatccagatttaccagacgctctccagcttcggcccgtcaatgctcagtgacgtggcggcgctgtcggtgctgatgggcgtgctggcgattggcattgtgtccttacagggcgtgatgcagcgacgccacgcgctgccgttgatcggcatggcggggcggtcgctggatttccagctgggtaaatggcggctggcgacggaatcgctgctggcggtggtgctgttcgccattttgctgctgccgctgctggcgctgatcgccacctcactggtgccgactctcggcgtaccgctcaatagccaaaccctgacgttcgccgcctggcatgcgatgttcgataaccagagcgccacctggcgcgcgctcaccaacagtatggtgctgtcggtttccgccgcgctgctgctgatgctgatcgccctgccgctggcctggctgctggtgcgctacgccagtcgcccgctgcgctggctgcaaaacgccatcgatattccctacaccctgccgggcgtggtgctggcgatcgccattatcctgctgttctcgcgcccgctgccgctgcttaacgtcagcctcagcggtacgctgatgatcatcttcatcgcctatctggcgcgctttctcaccgtctgcctgaaaccggtgcataacagcatgctgcaactggatccggcgatggaggaggccgccagcctcgccggcgcgaatttttcccagcgtctgcgccatattgtgctgccgttgctggccccggccgcctttgccggcgcgctgctggtctttctcaccgccgtgaatgaactcaccgtttcggcgctgctgtggagcgcaggcaaggagaccatcggcgtggtgattttcaacctcgatgagagcggcaataaagtgctggcgtcggcggtgtcggtgctggtggtggcgctggtgacctgtgtgatgttgttattaagcggcctgggtcgctatcttcccaaaggagttatcccgtggcagaactgaaactggaggggcttggcaaaaccttcggcgaacagaccgtggttcgcgatctgcacctcaccattccgcagggggcgtttacggcgttgctcgggccgagcggctgcggcaaaaccacgacgctgcgtattctggccgggcttgagcatctgagccacgggcggttatggctcggcgatcgcctgctggcggatgaaaaaatccatctgccgccggaggtgcgcaacatggggatggtgtttcagtcctatgccctgtggccgcacatgacggtggcggaaaacgtgggctatccgttaaagctgaaaaaagtgcagggcgcggcgcgacagaaacaggtgatggcggcgctggaggtggtggagctgggcgcgtacgccgaccgttccccgcaggcgttaagcggcgggcagcggcaacgggtggcgctggcgcgctgtctggtgtcggagccgcaggtggtgctgcttgatgagccgctggctaacctcgaccggcatctgcgcgccaccatggagcagacgttccgtgaatttcatcgccgtaccggcgcgacctttgtctatgtgacgcacgatcaggccgaagcgatggcgctggcaagccatatcgcggtgatgcataaaggggagctgatgcagtggggcacgccgcaggggctgtatcagcatccgcacagcgcctgggtggcgcgttttatcggcaaaggcagcgtgctggacgtcagggcgcaggctgatgaccgccagcttaacggcggcgaattgcaccgggcattaagcgccggggccgcggggctgtgtcagcaggtgctggtgcgccccgagcatgtcgaagtggcgcaggacggcctgcatgctgaagtggagagctgcatttatcagggcgagcgttatctgctggcgctgcgtctggcggacggtcagcagctgagcgcgtttcaccattcgccgctggatgtacagcaggcggtggcggtgcggctgcatcagggctggcgtctggaggccgcgtgaactttcgcatcgagatcatcagcggacttaaccagaaagcgcccgccgccattttactcagcacgccgtcgcagcgcattttgctggatgcgggcggggcgcttgatacagagagcgacgactgggcggtgccggataatctggatgcggtattgctgagtcacgatcacattgatcatatcgccgggctgtgccatctgccgccgcacgttccggtttactgtagcgcggtgacggcccgatcgctgcccgcgcaccgctctgttcaggtgattgcggtacgtggtcagttccggcttggcgatcttaccgtgactaccggcagttgcggccatgcctatggcggcgtctggtttcatttcgatgtaccgggcggtctgttttacagcggcgatatcagtatggagtcggcgctgtttcgcttcgatcccccgccgcgcgcagagattgcgctggtggatgcctcttacggattgtatgacaccccgcaatcgcagcagcgcgcgcacgttgccgcgtatctgcgtcagccgactttatgcccggtgccgccgtcaggtcgcgcagtggaaatcgcgctgcttgaagcgcaggctggacggctggcgatgacgctggacgacgactgccgggcgatgctgacggcgatggcagagtacgatgacggcagtttacagaccggcgtgcaggcaggcttacgcgcgctgcgccagcaactgccgccgttttccgtgaccgcgccgctgatcctcgccgccgatcctgacggacaaaccggcatggccggggcattacgcgcgcagccggatttttatcatcgcaccctttttaccggccacatgaacccgcgcgcccgccagcagtggcagagcggcgaggtggacttttgccgctggaacgtccacccgacgcggcgctgtctgcaacgtctggtgatgatgctcggctgtcatgcgctggctccgctgtttacgcctctggacgatgtgtcgcgctggcagcaggcgctgggctgcaccatcatcaccgacagcaccattgagagggaagtatgtcattaatctgtaagccgtttgtgctggtgcgccacggcgagacaccgcttaatcttgcacagcggatcggggggcgcagcgatgtgccgctgaccgcgcgcggcgaagaacaggcgcgtgccgcctcggcgctgctgatgcgccagcgctggagttgcattgccgtcagcccgttgctgcgcgctcgtcgtaccgctgaactggcgctgccgggccagcccctgaccctggtcgacgatctgcgggagcgggactggggtgacctggaagggatgcccattgcctcgcaaccgccctatgaacagacgccgccgcacggcgaatcatggcaggcattttgcgatcgcgtcaccagcgcgctgaaccttctgcttaccgcccacgagacgccgctgctggtggcgcattccgggatcttccgggtcattaatctgtatgccaccggcacgccatacggcgaacgtatggggaatgttgtaccgatgtggatcatgccaggcctgcgggctggcgaatgggaaattgtcccgctggaggaacgttatgtcgtatgaagagtgcgtgattgtcgatattgacggcacactcgccgaatttgatgcagaagctgtgcgtcagtgggtactgggcgaagagaagcagtggctgccgttttttgaacatatggcccaggcgctgccaggggtggcggtagcccgtcttgttggcatcctcagcgctcagcagcaaaaaatcgttatttgcagcggacgcccggccagttatcagcactacacgcagacatggctggagcagcacagtatcccgtttgatgcgctctatctgcggccggacgatgaagatcatcttgctgatgaagtggtaaaaaagcgcctgttgcagcgcattcgcgaggatggttatcagccctggctggtgatcgatgaccgccaggcggtggtggatttctggcgggccgaagggctgacctgcctgcaatgcgcgccgggggatttctagctgtcagggggcttccattaaccggctgatgtgaatactcagccaggtcagctcatcctttggcagtgtgagctgatatttttcctgcacatagtcgcggatcgcccaggcgacgttcatggcgtccgggcgatggcgcagcagttcctgatagaaatcgtcggtgtcactggcagtgacgttgccggcaatcagccgctcggcaaagtagcgcaggtgggtaataaaacggttgtagtttaccgagttgatgtcgagatttttattgagcttatagcgcacgatctccgcgatgcggttgaccagttccacctgctggtgggcgctggcctgatcgctactgcccgtcgcgttgataatatgaaaagcgatattcaccgcctcatcatccggcagcgtgacggcaaagcgggcgttcacctgctgcatcgcctgctggcctaacagatactctttctgataataccgcttcacttcccagctgagcttgttaaaaaacggctgatctttacggcagcgttctacggcaaaccacaggtgctcggcgagggtaaagaacagcacggcgttgagcttttccacatacgcctgctggatctgcgtgatgatgtcgtgggtaagctcaaaaaaagccgcaggaatggtgtccgtcagcgataaaaagtgccgggatttcagatccgccagcggcaggaagatcttttccacctgcgcaatgtcgataagctcgccgggtttgctgccaaacccgatgcccttaccgaacaggatcatctcctgctggtcatagtcgaccagcagcatactgttattcagcgacttttttactgttatcacggtcaattcctgcggctttacagccgttagtcgaggtcggccccgttgctggcgatcactttcttataccaccagaacgagtctttacgcagacgttccagcgagccattaccttcatcatcctgatcgacatagataaagccatagcgcttagacatttgcgacgtcccggcgctgatgatgtcaatcggcccccaggtggtgaagcccatcacctccacgccttcgttaatcgccgccagcgtttgcgcaaagtgggcgcggaaatagtcgatacggtagctgtcatggatttcgccattttccaccacgtctttcgcgcccaggccgttttcaacgataaacagcggttttttatagcggtcgtaaagctccagcagcgagattttcagccccacgggatcgatctgccagccccactcggacgccggaagatgtgggttcttcacgccaagaatggtgttgcccggcgtgcgctcgacgtctggctgggtgctttcagtaagagacatgtaatagctgaacgacacgaaatccacggtatgggctttgaggatcgccttatcctccggctgcatagcgatatgaatgtcgcggcgttcgaggtcgcgcaaaatcagcggcgggtattcgccagacacctgcacatcggcatagaagtagttttcgaggtttttcttcagcgtcgcttccacatcctccgggcggcagctgtagggatacgtggtcagtttggtgagcatacaacccacctggctgccggggattttggcatggcagtcgcgggtcaccagcgccgaggcgacaaactggtgatgcagcccctgataaatatcctgcttcgccttgcccggcgcgcttttatcttcgcggatccccgcagtggtaaacggatggcgatggatgctgtcgatttcgttaaacgtcagccagtaacgcaccacatctttatagcggtcgaaacagacatttgagaagcgcacaaaggcgtccagcacgttgcggtgcacccagccgttatatttttcgctcagcgccagcggcatttcataatgcgaaagcgtcaccagcggttcaatgttgtagtggcgcagctcgcggaacagatcgtcgtaaaattgcaggcccgcctcgttcggctcagcgtcttcaccggtggggaaaatgcgcgaccaggcaatggacacgcgcagcaccttaaagcccatctcggcgaacagcgcaatgtcgcctttatagcggtggtaaaagtcgatgccgcgccgtttcgggtagagcgcgtcgttttggccggttaaggcatcgctgacgttttcatcgctcagcgccaggtgaccatcatagcttttcagggaaagattcggtttccaggtgatggcgtcggccacggatggccctttgccgtcaacattccacgcgccttccgcctgattcgcggcaatggcaccgccccataaaaaaccctgcggaaagccagaatatttatccattacacggactcctttaacgtcatgatgatgtgaggatgagtggattgcgccccgcgcgcggcgggggcaatggcaaagcgttcgctgttggtgacgatcatcatcaccaccggatcgaatccggccgccacgatgtcatcaagatcaaaacggaccagaacatcgccggtgctgacgtgctggccttcgctcacctgcgggtgaaagccctgaccgttcagtttgatggtgtcgataccgatatgaaaaatcagctccacgccgtcatcggtcagcagactgaccgcatggcccgtgtcaaaaacgttcatgatggtgccgctggcaggcgcacgcagtatgccctgcgaagggatgatggcgatgccgtcgcccatgatgcgctttgagaagacatcgtccgcaacgcgctccagcgggatgattttcccctccaccggcggcgcgaaatccagctgacgttcagcggcctgcggcgttttatcccgccacagcagcagggcggcgaaaaaggcaatggcgaaggacaggccgccaccggcaaaggcccagagaatattcatgggattggttggtgagacgaacatggagatgctggcaaggccggggccgaccagcgcgaaggcttcaatcgccatccagccgataaaggcgccgccaatcacgctaccggcaatcacgctatagagcgcttttttatgcagcagcgtgacgccgtaaagcgcgggttccgtaatgccgaacagggcggaaatcccggcggaaatcgccgtggatttcagcgccctgtctttgctcttcagggcaatggcaaaacaggcgccggattcggcgatgttatgcgccagcgacgcgggcaggtagagcatttcgcgcccgaactggctcatcgacgccacggcgtaaggcagcatgggtttgtgcattccggcggccaccataaagggtaacgccgctgccagcaggcccgtcgccacgaatcccagtttgccgtagagccataagatcaccgttgccagtccggcccccagttcgtaacccagcgggcctaaaatcagcagcgtaacggggacagtgaccagcagcgacagcatcggcgagagaaaaatacgcagcgcgccgggggagtagcggttgaagattttttccgtctgcgcataaaacagcacgcataaaatcgccgggaatacctgcgaggcataggcaacgttctgtaaatcaagcgataaaaaggtcgcgccttctgccagctgcttcgacatggcgggcagcaccatcaccgataccgccgacaccgccaccagcacgttaactttcagcttcatggcggtggtgatggcgacgagaatgggcaggaaatagagcggtgcggaaccgatgttatccagcactttataggtggatgagtcccgcgtcagccagcccatcagatccagcaacagcagcagcgacttgagcacgccgccgcccgcaatggccggcaccagcggctgaaaaacgctgatcacaaaatccactatctttgcgccacggctgactttatcggttgcggacggtgtggcctgttgcggcgcgcccacaagcgatcttaccgcatcgtaaacctgcacgacgtcgtggccgatgatcacctgacactgtacgttgacccgtatgcctaacacgccgggaatgctttccagcgcgggctgatccactctggcgttatcgtgcaggctgagccgtaaccgtgtggagcagtgctcaatatgggcaatgttttctgcgcccccaatgtgggcgatgatatccagagctgtctgtaagtggttcatatcaggcctcatttatttggcgcaaaaaaaaacctgaagccttcccccactgtgcagagagggaaggcttcaggtcttgcctacgtaacgtagtaacacgccttagccttttatatcgtcgcagaacgtactgaaagtcaaacatccaccgcgcgaacgatgcataactgtgagctgattaacaactcgccgcccttttgtgaacgggcgacgaggtgcagtttcagctttttttcgcgccgtagcgtgcaaaccaggtcagcatgcgctgccagccatcctgcgcggattcggcgtggtagctcgggcgataatcggcgttaaaggcatgcccggcatcgggataaaccacgatttccgccgtggcgttagccgcccgcagcgcctggcgcatggtatcgacagtgtcctgcggaatactggagtcctgcgcgccgtaaagaccaagcaccggggcggtgagttcggtggcaatatccaccggatgcgacggcgagttcatggttttatcccccaccagtttgccgtaccacgccaccgccgctttcagctgcggattgtgcgcggcatacagccaggcgatgcggccgccccagcaaaaaccggtcgccagcaggcggtgcggatcgccgccgttgcgcgcagcccagttggcgacgtgatccagatccgccagcacctgcgcgtccggcacctttgaaaccagttcgctgaacagggtcggaatatcgtcatacgcattcggatccccctgacggaaatagagctccggcgccacggcaagatagccttccttcgccaggcgacggcagagatcgcggatgtgctcatgcacgccaaaaatttcctggatgacaatcaccaccggcagcgcgccggcagcctctgccggacgggcgtggtaggcaggcatattgtctccccgcgaggggatggacgtcagacccgctacaataccgtcgtcagcagtcgtgatggcggtggaggcatggggcgaagcagcaggggcaaagccgggttgtttgtcagtggtcatggcgatctccgtacccttgtagtggtgcaaaaaagtagcgcaataaataactatagtcagccgtctaaaatacagcgctcatgaaagcggctatcttttgaggagtgcccggctgacgaacatgttaatgtgatgtatatcactattttatggaaaaccactgcaaacaattttattggcggtgatggttgtcacgaaatttaacgtgcagcttctgtaaagtacctttttgctacttctgacaaaccgatctacagaggagtcacctatgtcacagtctgatgtttttcacctcggcctcactaaaaacgatttacaaggggctacgcttgccatcgtccctggcgacccggagcgagtggaaaagatcgccgcgctgatggataagccggttaagctggcatcgcaccgcgaattcacctcctggcgcgctgaactggacggcaagccggtgatcgtgtgctccaccggtatcggcggcccgtccacctctatcgccgtggaagagctggcgcagctgggcattcgtactttcctgcgcgtcggcaccaccggggcgatccagccgcacattaacgtcggcgacgtgctggtgaccaccgcctctgtacgccttgacggcgccagcctgcactttgcgccgatggaatacccggccgtcgctgattttgcctgcaccacggcgctggtcgaggcggcgaagtccgtcggcgccaccacgcacatcggcgtgaccgcctcttctgacaccttctatccgggtcaggaacgttatgacaccttctctggccgcgtggtaaaacgctacaaaggttccatggaagagtggcagtccatgggcgtaatgaactacgaaatggaatccgccacgctgctgaccatgtgttcaagccagggcctgcgcgccggtatggtggcgggcgtgatcgttaaccgcacccagcaggagatcccgaacgcggaaaccatgaagcagaccgaaagtcacgcggtgaaaatcgttgtggaagcggcgcgtcgcctgctgtagttcgcgttttttacctccatttccagggccgatccattcggccctttctttttgcgtagcgcctcgcaggaaatcccttcccaggtggacatctgtacagcacaatcttactttgcaccggacagtgatttttgcaggggaagatgtggatatttcaatactgttaagcgtggcggcagcgctgctgggcggcgtcatgctgggatggctggccatgaaatcgcgcgccgatcagctgcgggccgatctgctcgaagatcgccgggaactggacatcgaattaagcgcggccagacaacagctggcgcagaaccagcactggcgcaacgagtgcgaactgctgaataacgaactgcgcagcctgcgggaaattaatacctcgctggaagccgatctgcgcgaagtcaccacccgtcttgaatccacccaactgcatgcggaagacaaaatccgccagatgatcaacagtgaacagcgcctcagcgagcagttcgaaaacctcgccaaccgcatttttgaacagagcaaccgccgggtggatgagcagaaccgccagagcctcggcagtttactgacgccgctgcgcgaacagctggacggttttcgtcgtcaggtacaggacagctttgggcaggaggcgcgcgagcggcacacgctggcgcacgagatccgcaatctccagcaactgaacgcgcagatggcgcaggaagcggtgaacctcacccgcgccctcaagggcgataacaaaacccagggcaactggggcgaagtggtgttaacccgtgtgctggaggcgtccggcttgcggcacggttatgagtacgaaacccaggtcagtatcgagaccgacgcgcgggcgcgtatgcagccggatgtgattgtccgtctgccgcagggtaaagacgtggtgattgacgccaaaatgacgctggtggcctacgagcgctattttaacgccgaagaagactatacccgcgaaaccgcgttgcaggagcacctcgcctcggtgcgcagccacattcgtctgctgggccgcaaggattatcagcaattgccggggctgcgttcgctggattacgtgctgatgtttatccccgtcgaaccggcgtttttgctggcgctggatcggcagccggagctgatcaacgaagcattgaaaaacaatatcatgctggtcagccccaccaccctgctggtggcgctgcgcaccattgctaatctctggcgctacgagcatcaaagccgcaacgcccagcagatcgccgaccgcgccagccgcctgtacgacaaaatgcgcctgtttgtggatgatatgtcgtccatcggccaggggctggataaagcgcaggataactaccgccaggcgatgaaaaaactcacctccgggcgcggcaatctgctggcgcaggccgaggcgtttcgcgggctgggggtggaggtcaaacgcgagattaatccggatttggttgaacaggccaccgcccaggacgaggagtttcgtttgcgtgccggtgagccggacgctgaagaatctcaggaagacaatgaattagctacgcgagccgcggtgaatgacagcccggagcgcgtatcgcaaggcggttgaaacatagggcaattgcgcccaatctgttacacttcacgaacaatttcttgataagcaggcactgagatggcggaagatcgacaagaaacttcacaggacacgacccactttggttatcagaccgtcgccaaaacgcagaaagctgacatggtggcgcacgtatttcattccgtggcggcaaaatacgatgtcatgaacgatctgatgtcctttggcatccatcgtttatggaagcgttttacgatcgattgcagcggcgtgcgccgtgggcagaaagtgctcgatctggcaggcggcaccggtgatctgacggcgaaattctcgcgtctggtgggtgaaaccgggcaagtggtgctggcagatattaacgactcgatgctgaaagtgggccgcgacaagctgcgtaatattggcgtcatcggcaacgttgaatatgtacaggcgaatgccgaagcgctgccgttcccggataacacctttgactgcattactatctcctttggtctgcgtaacgtgaccgataaagagaaagcgctgcgttcaatgttccgcgtgctgaagccgggcggtcgtctgctggtgctggaattctccaaaccggttatcgagccgctgagtaaagcctatgacgcctactcgttccatattctgccgcgcatcggcgaactggttgccagcgacgccggtagctatcgttatctggcagaatccattcgtatgcatcccaatcaggatacgctgaaggcgatgatgcaggacgcgggctttgaaaatgtcgattactacaatctgaccgccggtatcgttgccctgcatcgtggttataagttctgacaggagtctgccatgccctttaagcctttaatgaccgccgggatagagcgtgtgcttaatacgtttttataccgtcctcaggccctgaaacctgcacgccagcgcttacagggcaaggtgctgcgtattgtcgtcaaagagctttccacgccgctggtgctggcgttcagcgagcgtcagcttgatgtgctgggcgagtgggagggcgaagcagactgtacggtcattacccgactgcgcgtcctgccgaccctgcgcgatcgtaaacagctcacctcgcttatccgtagcggcgagctggaagtgcagggcgatttgcaggtggtgcaaaacttcggggcattaatggatctggccgagtttgacgcggcggagctgttagcgccctggaccggtgatattgccgctgaaggcatcagccaggcgctgcgcggcggcacggcctttgtacgcaagaattttcagcgccagcagcagtatgtcgctgaaaccctgaccgaggagtggcgtatggcacccggcgcgctggaagtggcctggttcgcagaagaaaccgcagctatcgcgcgttcggttgacgcgttaacccaccgtctggaaaaactggagggcaaatgacgcctggtgaaattcggcgcctttacttcatcatccaaacttttttgagttacgggcttgatgagctcatccccagaatgcgtcttaccatgccgcttcgcctctggcgccgcacgctgttctggatgccaaatcgccacaaagacaaggaattaggccatcgcctgcgtctggcattacaggaactgggcccggtatggattaaattcggacagatgctgtccacccgccgcgaccttttcccgccggtcattgccgaccagcttgccatgttgcaggaccgcgtggcgcctttcgatggcgcgctggctaagcgacaaatcgaaaaagcgatgggcggtattcctgttgaaacctggtttgatgattttgacatcaagccgctggcgtcggcgtctattgcgcaggtgcataccgcccggctgaaagagaacggcaaagaggtggtcatcaaagtgatccgcccggacattttgccggtcatcaaagccgatatgcgccttatctaccgccttgcccgctgggtgccgcgcttgctgccggatggtcgccgtttgcgtccgctggaagtggtgcatgaatacgaaaaaacgctgatcgacgagctgaatttactgcgcgaagccgctaacgccatccagctgcgccgcaatttcgaagacagcccgatgctctacgtgccggaaatttactccgactattgcagccaggacatgctggtgatggagcgtatttacggcatccccatcaacgacgtggcggcgctggagaaaaacggcaccaatctgaagttgctggcagagcgtggcgtacaggtgttctttactcaggtgttccgcgacagcttcttccatgcggatatgcatccgggcaatatttttgtcagctatgaacatccggaagatccgcagtatatcgggatcgactgcggcatcgtgggttcgctgaacaaagaagacaagcgctatctggccgagaactttatcgccttctttaaccgcgactaccgtaaagtggcggaattgcatgtggattcaggctgggtaccgccggacaccaacgtggaagagttcgagttcgctatccgcaccgtctgcgagcctatcttcgagaagccgctggcggagatctcctttggtcacgtgctgctgaatctgttcaataccgcgcgccgcttcaatatggaagtgcaaccgcagctggtgctgctgcaaaagacgctgctgtatgtggaaggggttggccgtcagctctatccgcagctcgatttatggaaaaccgcgaaacctttccttgaatcctggatcaaagatcaggtgggcattccggcgctgatccgttcgctgaaagaaaaagcgccgttctgggtggaaaaaatgccggaactgccggagctgatttacaacaatctgcgccagagtaagcagttgcagcacagcgtggagcaaatctcccgtgatctgcacgttaaccatatgcgtcaggggcaatcgcgctatttgttcggcattggggcaacgttgatactcagtggtacattattgctgattaaccgccctgattggcagtcggccccggcctggctgatggcgggcgggctggtcatctggctgattggctggcgtaagacgcgcgcaatttgatcgttcacaacgggccgcttaacgtatactgtggcccggtttattcatcatttatcactggggataaggtatgggtggtatcagtatttggcagttacttatcatcgccgtcatcgttgtgctgctgttcggcactaaaaaactcggttcgattggttcagatttaggcgcatcgatcaaaggcttcaaaaaagccatgagcgatgatgacaaacatgcaaaaccggcagaagacgcggattttacggcgaaatccattgctgaaaagccggatgatgtgaagaaagaagacgcgaagcgtcacgataaagagcaggtgtaattcgtgttcgatattggctttggtgaattagttctggttttcgttatcggcctcattgttctggggccgcaacgtctgccagtggcggttaaaacggtggcaggctgggtacgcgcgctgcgctcccttgcctctaccgtacaaaatgaacttgcccaggagcttaagcttcaggaatttcaggacagcctgaagaaagttgaaaaagccagtctggataatctgacgccggaactgaaagcctccatggatgaactgcgtgaagcggcggaatcgatgaagcgctcctacagcgctaacgatccggagaaagagagcgatgtcgcgcataccatccataatccgctggtaaaagataacgaagcgcagcatgaaggcattacgccagccacggcagaaaatcaggccagcgcgccggaacagaagccgtcgacggagcctgaagacaacgctgtccggccgaacgatgccgctgtcgtgaaaagccccgtacaggcagcgcctgcttccgattcaaccccttcaacgagtggtaaatcttaaacatggctgtagaagatacccaaccgctgatctcgcatctgattgaactgcgtaagcgtctgctgaacagcattatcgccgtgctgctgatttttctggcgctggtctattttgccaatgacatttatcaactggtgtcggccccgctgatcaagcagatgccggaaggcgccactatgatcgccaccgatgtggcatcgccgttctttacgccgatcaagctgacttttatggtgtcgctgatcctctctgcgccggttattctctatcaggtgtgggcatttgtggcgccggcgctgtaccggcatgaacgccgtctggtgatcccgctgctggtttccagttcgctgctgttttacatcgggatggcgttcgcctatttcgtggtcttcccgctggcgtttggcttcctgacgcataccgcgcccgttggcgtgcaggtttcaacagatattgccagctaccttgatttcgtcatggcgttgtttatggcctttggcgtgtcctttgaagtgccggtggctattgtgcttatctgctggatgggcgtgaccacgccggaagaactgcgcaagaaacgcccttatgtattagtgggggcgtttgtggtcgggatgctgctgacgccgccggatgttttctcgcagacgctgctggcgatcccgatgtattgcctgtttgaaatcggcgtatttttctcgcggttctacgtcggcaagcggcgtttccgcagcgacgaaagcgacgaagacgacagcgaaagcacaaaagagtaatcaatggccgcccgaaagggcggttgtcatatggaggacggcatgtttgatattggggtcaacctgaccagttcgcagttcgctacagacagcgatgaggtggtggcgcgggctttcgccgcgggcgttaaaggcatgctgctgaccggcaccagtctgcatgacagcgagcaggcacagcggctggctcagcgtcatgcgcattgctggtctacggcgggcgtgcatccccatgacagcagccagtgggatgcaaacaccgcagacgcggttttcgcgctggcccgtcagccggaagtggtggcgattggcgaatgcggcctggattttaaccgcaatttttccccggcagccgatcaggaagcggctttttccgcacagctggcgattgccgcagagctgtcgatgccggtatttttacactgtcgcgatgcccatgaacgttttctggcgctgctgacgccgtggctggataagctgccgggcgcggtgctgcactgttttaccggatcgcaggccgaggcggaggaatgtctggcgaaagggttatatctgggcatcaccggctgggtatgtgatgagcgtcgtggcgcggagctgtgcgccgtggtgccgcgtatcccggctgaccggctgctggtggagacggacgcgccttatctgctgccgcgcgatctcaaacccaaacccgcctcgcgacgcaatgagcctgcgtatctgggacatatagttgagcgcattgcggccctgcgcggtgaaacggcagaggcggtgagcaatgccacggatgcgaacgtaaagcagctgtttggcgtgacgttttaagccggatcggctttgcggaactcagtgttcttcacgctttgcagcacttgcttgttgaggaagttgagcagcagcatcgagcgcgcttcgccatccggctcggtaaagatggcctgcaggccggtaaaagcgccttcggtgatcaccacattgtcgcccgcgtatggcgtatcgggatcggtgatcccttccggctgacaggtggagagttgttcaatgaccgtgggcggcaccgtcgccgggctggcgccaaaacgcacaaaatggctgacgccgcgcgtggcgctgatggtcgtggtatgaatgatttccggatcaaactggacgaacagataattagggaaaagcggttcattgacgcgggtacgtttaccgcgcaccattttttccagctcgatcatcggcgtcagacagttgacggcctggcgttcaaggtgttcctgagcgcgctgaagctgtccccgtttgcaatacaataaataccaggcttgcatcatcatccttcccttgtgttcgggcgcaaggataccacaatcgcgttgttgattatatcgggtgcgggcgacgcgtttgcagtgagttttacgcttatttaacaaaattacagcatcacgcgggcgttcgccgtataataatccgcttacagagaggccatgattaactgcatgaaataccacgacctacgcgactttatggcgctgctcgaacagcagggcgaactcaaacgcatcacgtttccggttgacccccatctggagattaccgagatagccgaccgcaccctgcgtgccggtggcccggcgctgttattcgaaaatcccaaaggttactccatgcccgtgctgtgcaatttatttggcacaccgcgccgcgtggcgttaggtatggggcaggaagatgtcacggcgctgcgtgaagttggcaagctgctggcctttttaaaggagccggagccgccgaaagggtttcgcgatctgttcgataagctgccgcagtttaagcaggtgctcaacatgccgacgaaacgtctgcgtggcgcgccctgccagcaaaaagtggtgcagggcgatgccgtcgatctgacgaaaatccctatcatgcagtgctggccggatgacgccgcgccgctgatcacctgggggctgacggtcacccgtggtccgcacaaagagcggcagaacctcggcatctatcgccagcagttaatcggcaagaataaactcatcatgcgctggctgtcgcatcgcggcggcgcgctggattaccaggagtggtgcaacgcccgtcccggcgagcgcttcccggtggcagtggcgttgggcgctgacccggcgacgattttgggtgccgtaaccccggtgccggacacgctgtctgaatatgcctttgcgggtctgctgcgcgggacgaaaacggaagtggtgaagtgtatttccagcgatctggaagtgcccgccagcgcggaaatcgtccttgaaggctatattgaagcgggcgaaatggcgccggaagggccgtatggcgaccatacgggctattataacgaagtggataatttcccagtcttcacggtgacgcacattacgcagcgtgacgatgcgatttatcattccacttataccggccgtccgccggatgaaccggcggtgctgggcgtggcgctgaacgaagtgttcgtaccgatcctgcaaaagcagttcccggagatcgtcgatttttatctgccgccggaaggctgttcctatcgcctggcggtagtaacgattaaaaagcagtatgccggacatgccaagcgcgtgatgatgggcgtgtggtcattcctgcgccagtttatgtacaccaagtttgtgatcgtgtgcgatgacgacgtcaatgcccgcgactggaacgatgtgatttgggcgatcaccacccgtatggacccggccagggatacggtgctggtagagaacacgccgatagattatctggactttgcctcaccggtttccggtcttggttcaaaaatgggcctggatgccaccaacaaatggcccggcgaaacccagcgtgaatggggacgaccgattgttaaggatcctgcggtgacggcgcgtgtcgacgccatctgggatgaactggccatctttaatgacgagaacagacccgacagagggagcgcatgacaaccttaagctgtaaagtgacctcggtagatgctattaccgatacggtatatcgcgtccgtttagtgccggaagcagacttttccttccgcgcgggacagtatctgatggtcgtgatggacgagcgcgacaaacgccccttttcgatggcctccacgcctgatgagcgtgagtttattgaactgcacatcggcgcatctgaactcaacctctatgccatggcggtgatggatcgcatcctcaaagaaaatgagatcctgattgatatgcctcacggcgacgcctggctgcgcgatgacgaagagcgcccgctgattttgatcgccggcggcaccggcttctcctacgtgcgttccattctgctgacgtcgctttcgcgcaacgccaaccgcgatatcaccctgtactggggcgggcgcgaagagaagcacctttacgatctggccgagctggaagcgttatcggtgaatcacccgaatctgcgtattgaagcggtggttgagcagccggaagagaactggcgcgggcgcagcggcacggtgttaacggcggtgttgcaggatcacggtacgctggcgggacacgatatttatatcgccggacgcttcgagatggcgaaaatcgcccgcgacctgttctgtaacgaacgcggcgcgcgtgaagaccgtctgtttggcgatgcgttcgcgtttatttgatttttttccctcactccggccctctccccagggagagggtaaaagtaacgggaaattaccaataaaaaacccgcccctgacaggcgggaaaaacggcaactaaaacgtttttactttactcagactcgctcaaatactgtcgcgatgccctgacctaaaccgatacacatggtggccagaccgaactgcgcgtctttgcgttccatcagattcagcagcgtagtgctgatacgcgctccggaacagcccagcggatgccccagcgcgatcgcgccgccgttgaggttgatcttctcgtcgatctgctccatcagccccagatctttaatgcacggcaggatctgtgcggcaaaggcttcgttcatctcaaacagatcgatatcgctggcagtcagcccggcttttttcagcgccagttttgacgccggtaccgggccgtaacccataatcgacggatcgcagccaaccaccgccatggaacgaatacgggcacggggtttcaggcccagctcgcgggcgcggctttcgctcatcagcagcatggcggcagcgccgtcggacagggcggaagaggtgcccgccgtaaccgtaccgttcgccggatcaaaagccggtcggagagtggaaagcgcctccaccgtggtttccgggcggatcacttcgtcgtaattaaactgtttcagcacgccgtccgcatcgtggccgccggtcgggatgatttcatttttaaatgcgccggactgcgtggccgcccaggcacgggcgtgagagcgggcggcaaactgatcctgcatttcacggctgatgccatgcatacgggccagcatttcagcggttaagcccatcatgcccgctgctttcgccacgttacggctgaggcctgggtggaaatcgacgccgtgattcatcggcacatggcccatgtgctcaacgccgccaatcagacaggcctgcgcatcgccggtcatgatcatacgcgcagcgtcgtgcagcgcctgcattgacgaaccgcacaggcggttgacggtgttcgccggtaccgaatgcgggatctccgccagcagcgcggcgttacgggcgatgttaaaaccctgctccagcgtctgctgaacgcagccccagtaaatatcgtcaagcgcggcggcttccagctgcgcattacgcgacagcaggctgcgcatcaaatgggcggagagatcttccgcccgcacatggcggaatgcgcccccttttgaacggcccatcggggtacggatcgcatcaacaatgactacctgttccatcgtcactccttaagccgtgtgtgtttcaatcaccgggcgagcaggctcagccaggggataatagggttcgttatggcgcgctttttcatgcagtccttccggcacctgatagagcgggccgagatgctggtactgctgggccatatcgagatattttgcgctgccctgggtgtccagccagcggaatgcgccgccatggaacggcgggaagccaaggccgtacaccagcgccatatccgcttcggcggggctggcgataatgctttcttccagacaacgcaccacttcgttaaccatcggtatcatcatgcgggcgataatttcttcatcggagaaatcacgcttcggctgactgacgcccgccagcagttcatccactgcgctgtcttcttctttcttcggcttgcctttgctgtcttctttataacgccagaagccctgaccgtttttctgcccgaaacgaccggcgtcaaacagcgcgtcgatagcatcacggtaatctttctgcatacgctgcgggaagccttctgccatcactgcctgagcgtggtgggcggtatcaataccgacgacatccagcaggtacgccgggcccatcggccatccgaactgtttttccatcactttgtcgattttgcggaagtccgcgccgtcgcgcagtaactggctgaaaccggcaaagtaggggaacagcacgcggttgacgaaaaagcccgggcagtcgttaaccacaatcggggttttgcccattttgctcgcccaggccaccactttggcgatggtgctgtcggcggttttctcgccgcgaatgatctccaccagcggcatacggtgcaccgggttaaagaagtgcatcccgcagaagttttccgggcgttgcagcacgctggccagttcgctaatcggaatggtggaagtgttggacgccagtaccgtatccggacgcacgcggctttccgtttcggtgagcaccgcttttttcaccttcgggttttccaccaccgcttcgacaaccacatcaacgcgctcaaagccggcgtaatccagcgtcgggtggatagtcccgatcaccccggccagcttcaggccgtcaatttttccgcgctcaagctgtttattcagcagcttcgcggcttcgttcatgccgagggtgagggatttgtcgttgatatctttcatgatcaccggcacgcctttccaggcggactggtaagcgatgccgccgcccatgatgcctgcgcccagtacagcggcctgttgcggggcgtccgtgtctttggtgagttttttggcctggcctttgacgtactggtcgttaaggaagatgccgaccagcgcgcgggcttcgttagtgtgggccagcggtacgaagctctggttttccagcttcagcgcttcttcgcggccatatttcgccgcggcctcgatggtttttactgccgtgaggggggccggataatgttttccggcggtctgcatcaccatggctttggcgatggagaaactcatggcggcttcaattttgcttaatttaagcggttcgagcttcggctggcgtttggctttccagtccagatcgccattaatggcctgacgcaggatcgccaccgcgccgtcgcggagtttttccggcttcacgatgccatccaccaggccaattttcagtgcctgtgcggcatccacgtctttaccggcggcaataatttccagcgcgctgtctgcgcccagcaggcgcggcatacgcactgaaccgccaaagcccggcatgatgcccagtttggtttcgggcaggccaatgcgcagctccggggtggcgagacggtaatcggtcgccagcacgcattcacagccgccgccgagggcgtaaccgttcacggccgaaatggtcggcaccggcaaatcttccagacggttaaatacgctgttggcgaaatgcagccactggctgagctgttcctgcggcacctggaacagggaaaggaattcggtgatgtcggcgccgacaataaaggccgctttgtctgaacgcagcagcagcccttttaaatccgcttgtttttccaccacgccgagcgcctcgccgaggctggctacggttgccgtgtcgagcttgttgactgagcctggcgcgctgaacaccagttcggcaatgccgtcttccagccagtcgaggtacagggtatcgcctttgtagagcatgtcagtctcctgaatccagcatcattactggtcttaccagatgagacggagtgtggtttttatgttaataaattgcaaatgactctttaaaaagttgcagcgccgatcacgcttagcggaaatcacgcagcctttcgctcctgtgctaagatgcgaacaattcaggctaaaactagcgaagggaatatcatggaatcactggccgcactctataaaaatcatattgttacgttacaggaacgcacccgcgatgttctggcccgctttaagctggatgcgctgctcatccactccggcgagctgatgaatgtcttccttgacgaccatgcttatccgtttaaggtcaacccgcagttcaaggcgtgggtgccggttacgcaggtgcctaactgctggttgctggtggatggggtgaataaaccgaaactgtggttctatctgccggtggattactggcacaacgtggaaccgctgccggtgtccttctggaccgaagaaatcgacattatcgcgctgccgaaagccgacgatatcggcagccagctgcctgcggcgcggggcaatatcgcctatatcgggccggtcacggaacgtgctgccgcgcttgagatcaaagcggaacatatcaacccgaaaggggtgatcgactacctgcattattatcgcgcttataaaaccgactatgagctggcctgtatgcgtgaagcgcagaagaccgccgtgatgggccatcgcgccgcccatgaagccttccagtccgggatgagtgagttcgatattaacctcgcctatctgaccgccaccgggcatcgtgatatcgatgtgccctatggcaatattgtggcgctgaatgaacacgcgtctgtgctgcactatacgaagctggatcaccgtgcgccgtctgaaatgcgcagtttcctgttggatgctggcgcagaatacaacggttatgccgcggatcttacccgtacctgggctgcgaacagcgataccgattttgcccagctcatcaaagacgttaatgaagaacagctggcgctgatcggcaccatgaaagcgggcgtcaattatgtggagtaccacatccagttccatcagcgcatcgcgaaactgctgcgccgtcatcagatcgtcaccgatatgagcgaagaggcgatggtggaaaacgatctgacggggccgtttatgccgcacggtattggtcacccgctggggctgcaggtgcacgacgtcgccggatttatgcaggatgacacgggtacgcacatggctgcgccgtcgaaatatccttatctgcgctgtacgcgcgtgatgcagccgcgcatggtggtgaccattgagccagggatttactttattgagtctctgctggcaccgtggcgtgaaggggcgttcagcaagcacttcaactggcagaaaattgacgcgcttaaaccgttcggcggcatccgcattgaagataacgtggtgatccatgaaaacggcgtggaaaacatgacgcgggatctgaagctggcgtaatggaaagctggccgataccggcagagccggttaccgttacggaagagatcaaaaagagccgctttatcacgctgctggcgcataccgatggcgtggaggcggcaaaagcctttgttgagtcggtacgatcggcccacccggatgcacggcaccattgtgtcgcctgggtggctggcgcgccggacgattcgcagcaactgggtttctcggatgacggtgaaccgtcgggcacggccggcaaaccgatgctggcgcagctgatgggcagcggcgtcggcgaaatcaccgccgtggtggtgcgctactatggcggtgttttattagggacgggcgggctggtaaaagcctatggcggcggggtgcagcgtgcgctgaatcagcttacctccatccgcaaaatgccattaaccgcatatactttgagctgtgattacgcccagctggcgggtattgagtcgctgcttttacagttcgaaggaaagatcgtcgacagtcagtatcaggatctggtgcacctgcgggtagcgcttccgcacagcagactggatgaattttcggcaaagctggcggattttagccgtggttcattgcaattactggcgattgaagaataatccccacctcatttcttactacctaaggacgcggcagagatgcatttccgtgccataacccgaattgttggactgctggtcattttattttccgggaccatgatcctgcccggactggtcgctctcctttaccgtgacggtgcggggcgcgcatttacacaaaccttttttgtggcgctggcgattggttcgctgctgtggtggcccaaccgccgccagaagggcgaactgaaatcccgggaaggctttctgatcgtcgtgctgttctggacggtgctgggcagcgtgggggcattgccctttattttctctgaacgcccaaacctgacggtcaccgatgcgttttttgaatctttctccggtttaaccaccaccggggcgacgacgctggtggggctggacacgctaccgcatgccatcctgttctaccggcagatgctgcaatggttcggcggtatggggatcatcgtgctggcggtggccattctgcctatcctcggggtcggggggatgcagctctatcgcgcggaaatgcccggcccgctgaaagataacaaaatgcgcccgcgtattgccgaaacggcgaaaaccctgtggcttatctatgtcctgctgacggtggcctgtgcgctggcgttatggtttgccgggatgcccgcttttgatgctatcagccatagtttcgccaccatcgccattggcggtttctccacccatgacgccagcgtgggttacttcgacagtccgaccattaacaccattatcgctattttcctgctgatctccggctgtaactatggcctgcacttctctttattaagcggtcgcaacctgaaagtgtactcgcgcgatccggaattcaggatgtttatcggcgtgcaactgacgctggtgttcatctgtacgctggtgctgtggttccacgatgtgtacgactcggcggtcaccacccttaaccaggcttttttccaggtggtgtcgatggcgacgaccgccggatttactaccgacagcattgcgcgctggccgctgttcctgccggtgctgttactctgttcggcttttattggcggctgcgccgggtcaacggggggcgggctgaaagtgatccgtatcctgctactgtttaagcagggcaaccgtgaactgaagcgtctggtccacccgaatgcggtttacagcatcaagctggggaaccgagcgttaccggaacgtattctggaagcggtatgggggttcttctccgcatatgcgctggtgtttatcgtcagtatgctggccatcattgctaccggcgtggacgatttctctgcttttgcctccgtggtggcaacgctgaataacctcggcccggggctgggcgtggtggctgataactttgccagtatgaatcccatcgccaagtgggtactcatcgccaacatgctgtttggtcgtcttgaagtctttacgttgttggtgctcttcaccccaacgttctggcgtgaataaggaagcttttgtgaaaacgttaatattgttctccacccgggacgggcaaacgcgtgaaattgcctcttttatagcatcccagcttaatgagcttggcgtgcatgcggatgtggtgaatctgaatcgcgccgatgcgattaactgggctgaatatcatcgtgtcgtgattggggcatcaattcgctacggacattttcatccggcagtggaccgcttcgttaaaaagcacctgcaggagctgaacgcgcgaccgggtgctttcttctcggtgaacctggtggcgcgtaagccggagaagcgtacgccgcagaccaacagctatacccgcaagttcctgcttaactcgccatggcagccagaccagtgtgccgtgtttgcgggggcgcttcgttatccgcgttatggctggcttgatcgcgtcatgatccgtctgattatgaaaatgacgggcggtgaaacggataccagtaaagaagtggtgtataccgactgggataatgtcgccgctttcgcccgtgatatcgctcatttaacccacaaatcgtcgttaaatcaggcgtaacgcctggaaattgagcggttaaaaagttttttgcattttagacttgtcagcccggaataactccctataatgcgccaccactgacacggaacaacggcttacaggccaccgggtcagaaggtcttcctccgggaatgaccggcagagaaaagcaaaataatcgcttgactctgaatgaggaaaacgtattatacgggacctcgcgacacagcgccaaagcgcgtcgcaactgctctttaacaatttatcagacaatctgtgtgggcactcaaggacatggattcttaaacgtcgaaagacgctaaatgaataccaagtctctggagtgaacatacgtaattcattacgaagtttaattcacgagcatcaaacttaaattgaagagtttgatcatggctcagattgaacgctggcggcaggccta

SEQ ID NO: 7 - DNA, 50247 bp, Enterobacter sp SA187
taggcctgccgccagcgttcaatctgagccatgatcaaactcttcaatttaagtttgatgctcgtgaattaaacttcgtaatgaattacgtatgttcactccagagacttggtattcatttagcgtctttcgacgtttaagaatccatgtccttgagtgcccacacagattgtctgataaattgttaaagagcagttgcgacgcgctttggcgctgtgtcgcgaggtcccgtataatacgttttcctcattcagagtcaagcgattattttgcttttctctgccggtcattcccggaggaagaccttctgacccggtggcctgtaagccgttgttccgtgtcagtggtggcgcattatagggagttattccgggctgacaagtctaaaattaaaaaaacttatcgatcgcacaatattcatacaaaacgagccagtgaagcgtattttcgcctggtttttaaacaaaaacgagccgcgcagggctcgttttcttcgttttgtgaattactgcacggcaactatttgctcatctttaaccaccagctggatggttttgccaggaataagctccccggacaagatttgctgtgccagcgggttctcaatctgctgctggatggcacgttttaatggccgcgccccataaaccggatcaaacccattggcgctgagcattttcagtgcctcatcggtgatatgcacatcatagccccgatcttccagacgctgatacagacgttgcagctggatcttcgcaatagaagcaatatggttttcaccgagcggatggaagaccaccacttcatcaatacggtttagaaattccggacggaagttctggctgaccacgcccagcaccacatccttcatatgactgtagtccagttcgccgaaacgctcctgaatcagatcggatcccaggttcgaggtcataatgactaccgtgttacggaagtcgaccgtccgcccctgtccgtctgtcaggcgtccgtcgtcaagtacctgcagtaagacgttgaacacatccggatgcgccttctcgatttcatccagcaggatgacagagtaaggacgacgacgaaccgcttcggttaagtaaccgccttcttcataaccgacatatcccggaggcgcgcccaccagacgtgataccgaatgtttctccataaactcggacatatcgatacgcaccatcgcgtcatcactgtcgaacataaagttagccagcgttttacagagttcggttttacccaccccggtcggcccgaggaacaagaacgaaccaatcgggcgattcggatctgataatccggcgcggctacgacgaatagcattagaaaccgcctcaacggcttcattctggccaatcacgcgaccgtgcagctcctgctccatacgcagtaatttgtcacgctcaccttccagcattctggctaccgggatgccggtccagcgcgccagcacttctgcgatttccgcatccgtgactttattacgcagcagacgcatggttttgccttctgactgtgtggcggcttcaagctgtttttcaagctcaggtattttaccgtactgaagttcagacatccgcgccagatcgccgacacgacgcgcctgttcaatggcgattttcgtctgctccagctccgatttaatggtctgcgtgccagaaagcgaggctttctccgctttccactcttcttccagttcagaatactgacgctctttgtcggacagctcatcattgagcatttccagacgttttttactcgcctcgtcagattctttcagcagcgcctgctgttccagcttcagctggataatacgccggtcgagacgatccagttcttcgggtttagagtcgatctgcatacggatgctggacgccgcttcatcgatcagatcgatggctttatccggcaactggcgatcggcaatatagcggtgtgacagggtcgccgcagcgacaatcgccgggtccgtgatctgcacatggtggtgcagctcatagcgctctttcagaccacgcaggatcgcaatggtgtcttcgacagaaggctcagcgacaaacactttctggaaacgacgctccagcgcggcatctttttcaatgtactgacggtattcatcaagcgtggtcgccccgacgcagtgcagttcaccgcgtgcgagcgccggtttcagcatgttcccggcatccatcgcgccgtcggctttacctgcgcccaccatggtgtgcagttcgtcaataaacaggatcacattaccttcctgtttagagagatcgttaagcacccctttcaggcgttcttcaaactcaccgcgatatttcgcgcccgctaccagcgaccccatatccagcgccagtacgcggcgacctttcagcccttccggcacttcaccattgacgatacgctgcgccagcccttcaacaatggcggttttaccgacgccaggttcaccgatcagcaccgggttgtttttggtacgacgttgtaacacctggatagtgcggcggatctcttcatcacggccgatcaccggatcgagcttgccctgttccgcccgttcggtcagatcgacagtaaattttttcagggcctgacgttggtcttctgccccctggtcattcacgctttcgcctccacgcatttgttcgattgcctgcgtcacattagcggtattcgcaccggcggctttcagtaagtctgccagcgtaccgcgcgactccagcgccgccagaacaaagagttctgaggaaataaaattgtcgccgcgcttttgcgccagtttgtcgcacaggttcagtacgcgaaccagatcctgcgacggctgcacatcgccgccggtgccttccacctgcggtaaacggcttaacgcctgctcaatagcggtgcgcagttggcccgcattgacgccagcagaggttaataaaggacgtaccgatcccccttcctgattcagcaaggcgctcataagatgaagaggttcgataaattgattgtcttgccccagcgccagagactgggcatcggcaagagcaagctggaacttattggtaagacgatccagacgcataactcctcccatagaaaacaggtcaaatttgctactggagattaaatgaggtcatccctcaattattcaaggttaatgacctgaataatatggaaagaaaatgacgcgcactggatcgtcttgattctttaggttatctcagccaaatgaaacttgccatacgcccggtggtcttgtcgcggcgatatgagtaaaattcgttcgtttctgtgaaggtgcaccggtcaccgccgaagatctgactaacgcctgcgcccgccagacgctgacgcgccagcagataaatattggcaagatacttttcatcgcgggcgacaaatgcggcgtccgcattcggatctactgccatgaaagcctcacggacttccggccccacttcaaacgcctgcggaccaatcgccgggccaagccaggccataatattgtccgggctatcgtcaaagcaggccagggtgttttcaagcacaccggcgcataaaccacgccagccagcatgagctgccgcgacttccgttcctgcacggttacagaacagtaccggcaggcaatccgctgtcatcacggcgcacacggttccgggcgtattgctgtatgacgcatcggcacgttttgaggcataaggcccgccgtccagacgctgcacctgatcaccgtgtacctgttccagccagaccggtttcgatggcaaaccgcccgcggcgaacatccgctgacgattttcctcgacgtgctccgggttatcaccgcaatgcgcacccaggttcagtgagtgccagggcgcgaggctcacgccgccgatgcgggtcgaactacaggccgccacgctctcaggctgcggccattgcgggataatcacgtgtgtcatagccagtctacgctgtccttatggatctggaagtcagcgcgcatggcctcgatcagatcgaccatgtcctgtgggataggcgcatgccattccatttcgatgccagtgatcgggtgataaagacgcagcatggtcgcgtgcagcgcctgacggtcaaactgacgcagcgcggcaataaattcatccgacgcgcctttcggcggacgcggacgaccaccgtacagctgatcgcccaccagcggatgggtaatgtgcgacatatgcacacggatctggtgtgtacgtccggtttccagacgcagacgcagacgcgtgtgcacacggaagtgttccataatgcgataatgcgtaaccgccggtttgcccatcggatgcacggacatatgcgtacgtttggtcgggtggcggctgataggctcttccactgtaccgcctgccgtcatatggccaatcgcgaccgcttcatattcacgggtgatctcgcgcagctgcagcgactccaccaggcgcgtttgcgcaggcacggtcttggcgaccaccatcaggccggtggtgtctttatccagacggtgcacgataccggcacggggaacatcagcaatcggcggatagtaatgcagcagcgcattcagtacggtgccatcagggttaccagcacccgggtgaaccaccagatcgcgcggcttattgatcaccagaatgtcatcatcttcatagacgatggtcagcggaatatcctgcggttcaaaacgcgcttcttcttcgatttcagcattgatggtgacgcgttcgccccccaatactttttcttttggtgtgctgcacaccttgccgttaatctcgacgcgctggtcaaggatccactcttttattcgcgatcgtgaataatcagggaacatttcggccaatgcctgatctaagcgttgaccgagttgattttcggacaccgttgcggtgagttgtactagttgtgccatagacagcttcttcgttaaccttgggtttttacggctttgccgtttaatatagtgtgctattgtagctggtcttaatcgggagcaggaacagagaatcctcccgcataaacattttgaggaaagtcaaaacgtcatgacgcgcatgaaatatctggtggcagccgccacgctgagcctggctttggtgggttgctccggttcaaaggaagaggtgcctgataatccgcctaatgaaatctacgcgactgctcagcaaaagttgcaggacggtaactggaaacaggcaataacgcaactggaagcgctggataaccgctatccgttcggcccgtattcccagcaagtacagctggatttgatctatgcgtactataaaaacgccgatctgccgctggctcaggccgcgattgaccgtttcatgcgtctgaacccgactcatccgaacattgactatgtcatgtacatgcgcggcctgactgatatggcgctggatgacagcgcattgcagggcttcttcggcgttgaccgtagcgaccgcgatccgcagcacgcgcgcgatgcctttaatgacttctcaaaactggtgcgtggctacccgaacagccagtatgtcacggatgccaccaaacgtctggtgttcctgaaagatcgcctcgcgaagtatgaatactccgtcgcgcaatactataccgatcgcggcgcatgggtggcggtggtaaaccgtgttgaaggcatgctgcgtgattatccggatacccaggcgacgcgtgacgcgttaccgctgatggaaaatgcataccgtaaactgcagctgaatgcgcaggcggacaaagtggcgaaaatcatcgccgccaacagcagcaatacctgattttcctccccaatgtaaaacggcagctcctgtgagctgccgtttttttatgcgttttacctgccgccggagcgggtttccgtgcaggccatccggtcaactatgccccctattatgagtatcaacaaggtaaaaattccgggttcacgttttaaatcacaaaaagctgtcgttgacaaaaagtgacgaaataatgtgattcaaatcacacattttgacactatgcaggttatgcttgttaataccaagacggaaagacaagaggtaacatctatgacaatgaacattaccagcaagcaaatggaaattactccggcaattcgccagcatgtcacagaccgtctcgccaaactggataaatggcaaacacacctgattaacccacatatcattctctctaaagagccgcagggctttaccgcggatgccaccatcaatacacctaacgggcatctggtcgccagtgcgaagcatgaagatatgtataccgcgattaacgacttgatcaacaagctggaacggcagctcaataaagtgcaacacaaaggtgaagcgcgtcgcgccaccacctcggtgaaagacgccaacttcgctgaagttgaagaagaagagtaatcctttacattgagtgtatcgccaacgcgccttcgggcgcgttttttattgacagggtgaaaacagtacggttactttactcagacacttgttcaggatcgcaccatgaaacttgttccgtttttcttcgcattcttttttaccttcccctgaccgggaggcgtttcgtcgtgtgataaagaatgcgaagacgaacaataaggcctcccacaccggggggccttttttattgataactataaaaaaggcaacactatgacaccggaaaacccgttactggatctgcgcataaagatcagcgctctggatgagcaattactgacgttactggcggaacgccgtctgcttgccgtggaagtgggtaaagcgaagctggcgtcccatcgtccggttcgcgatatcgatcgcgagcgcgatttgctggagcgcctgattacgcttggcaaagcgcagcatctggatgcgcattacattacccgcttgttccagctgatcattgaagattcagtgctgacccagcaggccctgcttcagcagcatctcaatcaaactaatccgcactcggcgcgcatcgcgtttcttggccccaaaggctcgtattcacaccttgcggcacgtcagtatgcggcccgccactttgaacagttcatcgaaagcggctgcgcaaagtttcacgacatctttaaccaggtggaaacgggccaggcggattacgcggtggtgcccattgaaaacaccagctcgggggctatcaacgatgtctacgatctgttgcagcacaccagcttatccatagtggcggaaatgacggtgcctattgaccactgcgtgctggtttccggccccaccagcctggatcagatccagacggtctacagccatccgcaacccttccagcagtgcagccagtttttgaatcgctatccgcactggaaaattgagtattgcgaaagcacctcggcagccatggagcgcgtggcgcaggcacagtcgccgcatgtagcggcgctgggcagtgaagcgggtggcgggctgtatggattgcaggtgctggagcgtaacctcgcgaaccagacgcaaaacattacgcgttttgtcgtgctggcccgtaaagcggtgaaagtatccgatcaggtgccggcgaaaaccacgctgctcattgccactggccagcaggcgggcgcgctggtagaggccctgctggtcctgcgtaatcacaatctgatcatgaccaagctggaatcccgtccgatttacggcaacccgtgggaagagatgttttatctggatattcaggccaacgtcgaatccgccgccatgcaaaaagccctgcacgaactgagcgagatcacccgctcaatgaaagtgctgggctgttatccgggggaaaacgttgtgccggtcgatccggcttaacgttccacgaaaagggactttttcacccctgccacctgcaccggcagggtgaaaatggcgcccgacagcggatattgcgccgtttcttccggggtcatgttttcccttgtagtggtaataaacagcgttttcatgtccgcgccgccgaaacagaccatcgtcgggcagcgtaccggcaggcgatattcttccagttgctcgccctgcggcgagaagcgcgcgatgcgccagccatcatagagcgcgctccagtagccgccttccacgtccaccgccgcgccatccggcattccctctccgtcagtaaagcgacgcagcaccttacgctgcccaggctcgccgtcggcgtcgagcggcgtgcagtaaatcaccttctccggcgtgtccgaggtgagcatccacttgccgtcaggactgaaggccagcccgttcgcgcccttgatgtcgcactggatcactttcggggtcagatcgttatcgatacgcatcagctgcgcgccgttataatcccccggcgcccagaaggtcccggcgtagaaacgcccgcgcggatcggtgccgccgtcgttgaaacgcgccagttgcggattggacggattgtcgcagactttattggtcagcagcccgcgcttatcggcgagccatatcgcagtgcgcatggcgacaataaaaccgcccttctcgcgtagcgcaaaacagcccacttcctccggaaagcgcagcacagaatgctcgcccgaggcgagatggtaacgatgaatttcgccttcaataatatcggcccagtaaagcgcctgctccgcctcactccaggtcgggcattccggcagatggccggtataatcaaacagcggttgcggttcagccataacaaatcccttcttataaaaaaagccagcggatcacccactggcttcaagtatatgcagcttttcagttattgacggctgtcgttcgcctggcgcagcaatacgcggctttcgctctggaaacgctcagcgtaatcgccgaaccagtgttccaccttacggaagctgtcgatgaaggcctgcttgttgccctgctccagcaggccaatcgcctcgccaaagcgctggtaatagcgtttgatcagcgccagattactttccgacgacataataatgtcggcatacagctgtggatcctgggcaaacagccttccgaccatcgccagttccagccggtaaatcggcgacgagagcgccagcaactgttcaagctgaacgttttcttccgccagatgcaggccataggcaaaggtggcgaagtggcgcagcgcctgaataaacgccatgtgctgatcgtgctccacggcgctgatgcggtgcagccgcgcgccccagacctggatctgctccaggaaccactgatacgcttccggctggcggccatcacagtacaccaccacctgcttggcgaggctgccgctgtccgggccgaacattgggtgcagacccagcaccgggccgttatgcgctgtcagcatcgcctgcaatggcccgctttttaccgacgccagatcaaccagaatgcagtcatccggcaatggcggcagtttagcgatgatcgactccgtcacgtgaataggcacgctgacaatcaccatacctgcgtccgccacaatggatgcagcgcgcgaccagtcctctttttccagaatgcgcacttcatagccggaaagctggagcattttctcaaacagccgccccatctgcccgccaccgccgacgatcaccaccgggcgcagcgtcggatgcagcgtcttaaagcctttgtcgttttcgctggaataggattcgcgcattacccggcgcaatacatcttcaatcagatccggcggcacgcccagcgcctgcgcttctttccggcgcgatgccagcattgaggcttcgcgctccggcacgtaaatcggcaaaccgtatttgctttttacttcgcccacttcggcgaccagcgccaggcggcgcgccagcagatccagcagcgccttatccacttcatcaatttgatcgcgcaacgcggtcaattctgcaaccatgacaacctcttaagcgtgacgcgtcgccagatgcgcgcgcaggtccttatcgatctcgcgcagcagcgcatcggtcgtttcccagctgatgcaggcatcggtaacggaaacgccatacttcatttcgctgcgcggctgctcggatgactgattgccttcgtgaatattactttcaatcatcagaccaataatcgaacggttgccatctttaatctgtgcgacaacagactctgcaaccgcaggctggcgacggtaatctttgttggaattaccatggctgcaatctaccatcagcgacggcttcagtcccgcctgcgtcatctctttttcacactgcgccacgtctgccggactgtagtttggcgctttgccgccgcgcaggatcacatgcccgtccggattgccctgcgtctgtaacaggcaaacctgtcccgcctgattgatccccacaaaacggtgcggcatggctgcggcgcgcatggcgttaattgccgtcgccaggctgccatcggtgccatttttaaagcccaccggcatggataaaccggaggccatttcgcggtgcgtttgtgattcggtggtacgcgcgccaatcgccgaccagctgaacagatcgcccaggtattgcgggctattcggatccagcgcttcggtcgccagcggcaggcccatacccaccagttctaccagcagacgacgcgcaatcttcaggcccgcttccacatcaaaagagccatccatatgcggatcgttaatcagccccttccagccaacggtggtacggggtttttcaaaatagacgcgcatcaccagatagaggctatcgctgacctctgcggcaagggctttaaaccgacgcgcgtattcaatggccgcttccggatcgtgaatggagcacggaccgcaaaccaccagcagacgcggatcgcgcccggcaataatgtcagacagcgtctgacgggattgctcgatttgcgcctgttgttccgccgtcagcgggaattccgctttcagctgatcgggcgtgattaatacgtgttcgtcggtaatatgtacgttgttcagcgcgtctttttgcatgatggcgatcctgtctggctcgtttgcgatagtgtctcgttgtgagagtgatttaacgataccacaaacggtaaacatttcaatccaaaatacgtacaccttactttacaatatgcattttaaggccatttaaatgcttttaacgtgtaaagataacaatacacagcagcatgtgccgttattcgggctacgcttacataacacacaggagaacgtaatgaagacaggtatggttttgcttttacccattttattgatcggctgctccgtagaaccttacagccatgccccgacctggaccggtacggactggtacagcgccggtaaagacgatgccctgtccggcgcggtcataaagaataatgagacgctggcgctcgagcacaacagcaaagaaattaaccgtccccggtacgcagagggttacgcggatggcctgaaaaagatctgtcaggatgattttctgtatgcctggggccgcgccgggaaaatttacccggcgggctgtgacacgcttgaaaatgccagcacttatcgtgcgcactggcaaaaaggcatggaagaaggcgcacgcgacagccggcttaattaagctatccgcgtgcggtgtttactccgcgacgggtcgccgggcgcaggctttgcgccagcgcagcacgtccaccgccagaaacagcagcaggctgacgcccagcaccggtaatgccagcgccagcagcagcgccaccacgctgaccacaatacgtcctgccacgggcagcgccagccagctttgcatcaatgtctgtaccgggctgacgttcgacccggcaggcctgcgcagccaccagagccggtaacccatcacaatcatcacgcacagtccaaggccaaaggcgatcagcaccagttgattgggcagcccgaacagcacgcccatatggaaatccacgccccaacgggtcagtttcgccatcaacgggaaatcctcaaaccgggtgctgtcgatcacctgcatagtatttgcgtccaccgccacggcatccacctgggtcggccagctacggtcgatttcggtgaccgtccaggcgctgttggcatcccgcggcgggcggatctcaagcttcgccgcattgatgccagccgcacgcgcgacctgcaatacttcatcaaactgtaccgagtcctcaacgctggcaggcatctccatgccatgatgatgaccatgatgttccgcatggggatcggctgcctgcgccgggccgtgcaactgggtgttcacctgcggcgtcatccagccgaaggcagcgcgcattttgtcaacgttcccgcccgcccactgggaccatgtcagcccggtgacggaaaacagcagcatgcccgccagcaggatccagccgagggtgacgtgtacccgccgggtattctggaagctgttgttcaggcggcgcttcgggcgcgtataaaaccacagcactatgccgccaagcgctgcggcccacatccaggacgccgccagttcactgtacagccgcccggtatcgccaagcagcagcgagcgatgcgcgtagtcaatgatttgccgcaacggcaggatgccgctggtgccatagacggtgtgatcccctttcaccgccagcgttaccggatcgataaaaatcgcccggtgctccgacacgccgagcgccggatcggcaaacattacgcgggtagtgtccgtatccgcgagtcccggacgcacggcatgcagacgcagatggccgccggtaacctgttccgccaccgcgatctgttccgccagcggctgacgttcgccggtagtggtaccgtaaagcgtatcggcataaaacaggttttccagctgtggggtggcaacgtacagcgtcccggtcagggccgccacaaagatgaacggcccgacaaacagaccaatataaaaatgcaggcgtcgcagcaggtttaaccaggccgcgcgcggggtgcaggtagtcatacttttccttactgaaagcaaaggttcgccttgtgcgcaggcacaggcttaatgggttttaacaggaaaaagcagactggcgcggcggcgcgcgggtttgaggataaagccagggaataaaacgccatgcccgttcgggcgggggaagcggtgcgatataaatacgggtaagcgtagcggagagaaaaagcaccgccagcaggatcaggccgggcacgtgcgccagcagtacgcaatagccgcaggcttcggcatgatcgaccggaataacgtccggcgcgctgtcgtggtgttcagccatcatgctcatgtcatgatgcatgcccggcatgctcgccatgggatctttttgcaggctgacagagataagcggcgcgaccaggatcagcaaaatagcaaacagggcgagccatgctgctttacgcttgatgctggtatgatgaaatgcgctctgtgtcacgactcctccgcatgcagggggtcattgtaaacgatttattggtttttggttaatctggcgggcaggttttgggcatgcggggaataaaaaaagggccgacccggaggtcagcccttttctgatgggatgtcgcgaaagcgatatcttagttaagacgctctttgatacgagcagacttaccagtgcgctcacgcaggtagtacagtttagctttacgtacagcaccacgacgtttaacagcaatgctgtcaactaccggagagtgagtctggaagacacgctcaacgccttcgccgttggaaattttacgaacagtgaatgcagagtgcagaccgcggttacgaatagcgataaccacgccctcgaatgcctgcagacgttttttggaaccttcaacaacccatactttcacttccacggtgtcacccggacggaaggaaggtacgtcctgcttcatctgctcttgttcaagttgcttaataatgttgctcataatttaatctcttatcctgggtaaactgatatttgggggcttacgcctgcccatcatgtttatgctgctgttgtgcgtgctcttttttgaactccgccagcaactttgcttgctcttcagtcagagccaggttttccagaagttcaggtcttctaagccaggtacggcccaacgactgtttcagacgccagcgacgtatctcggcatggttccccgacagcaatactgccggtacttccatcccttccaacacttcaggacgggtatagtgcggacagtccagcaatccatcggcaaaggaatcttcagttgccgaggcttcatgtcccagtacccccggaataaaccgggaaaccgagtcaatcagcgtcattgcgggtaactctccaccgctgagaacgtaatcgccgacagaccattcttcgtcaatctcggttttgattacgcgctcatctatcccttcgtagcggccacacaccagaatcagcttctgatgcgttgccagctcgctgacgcccgcttgatcaagcttgcgtccctgaggtgacagataaatcacctttgcgccttcacccgccgcggctttcgctgcgtggatggcgtcccgcaagggttgtaccatcatcagcatccccggtccgccgccgtaaggacgttcgtccacggtacggtgccggtcatgagcgaaatcacgcggactccagctctggatgctcagcaggccattttttacagcccggccagttaccccgtaatcagtaatcgcacggaacatttcaggaaacaggctaacgataccaataaacacgcgccaatccccttagcaccgacttttactatttatccggaggttttaaaaaccaggatcccaatctacttcaatggtgcgagtagtgagatcgacattcttgataacctgcccatcgaggaacggaaccaaccgctccttgataccaaatgcatctttcaggtttgccttgatgacgagaacgtcattggagccggtttccatcatatcaatgactttacccagcccgtacccttcggtggtcactacctggcagccaataaggtctttccagtagtagtcgccatcggtgagggccggcaactgcgaggtatctaccataatttcgcaattagtcagtagattcgcgctgtcacgatcgtcaacgcctttcagcttgatgatcagatcctgattgtggtgcttccagctttccagctgtacctgctcccactgacccgccttctggataaaccagggctgatagtcaaaaatgctttcggcgtcttcggtggaggaaaacactctgagccaaccacgaataccgtaggaagaacccattttgcccagtacaaccggttcaacagggacttttgcggcgagttgcttgctcatcatgaccaccgtgacagattaagctgctttttttgcttctttgatcagcgcagatacgcgatcagagatagttgcgccctggccaacccagtgagcgatgcgatccagatccaggcgggtgccttcttctttttcgctggcgatcgggttgaagaaaccaacgcgctcaatgaagcgaccgttacgtgcgttacggctgtcagtaacaacaacctggtagaacggacgctttttagcgccgtgacgtgctaaacgaatagttaccataacatcctcttgtgtgaataaaacaccgggccccctcggagggacggagcccggtgttatattaaaagcccgaaaattttactgatttctgggggaaatgcaatcaagatatagcaaaggggagatttaaggccgtcggcggtgcaggcagtttgacgtcggcgtgcgcggagtcgccggagcgtacacgtagtacgtgacggtgacgagcacaccccggtgtcaaaatggcaaacaagccaggccgggatatttatcgacccgggaatcctgggggcatcatccctttcatgcctctcatcattttcgccatcccgcccttcttcatcttcttcatcatgcgctgcatgtcgtcgaactgcttcagcaggcggttaacgtcctgcacctgcatgccgcaaccggcggcgatgcggcgcttgcgggaacctttaatgatttccggcttagcacgctctttcagcgtcattgagttaatgatcgcctccatacgcaccagcactttatcgtccatctgcgatttaacgttgtccgggatctgccccatgcccggcagcttgcccatcaggcttgccataccgcccatgtttttcatctggcgcagctgctccaggaagtcggtcagatcgaagccgtcgccttttttcagtttggtcgccagcttttcagcctgcgcgcggtcaactttgctttcgatatcttcgatcagcgacagcacgtcgcccatgccgagaatacgggacgcgatacggtccggatggaacggctccagcgcttcggttttctcgccgacgccgaggaacttgatcggcttaccggtaatatgacgaatggagagcgccgcaccgccgcgggcatcgccgtccactttggtcagcaccacgccggtcagcggcagcgcttcgttgaaggctttggcggtattcgccgcatcctgaccggtcatcgcatcgacgacaaacagcgtttccaccggcttgatcgcggcgtgaacctgtttgatttcgtccatcatcgcttcgtcaacgtgcagacgaccggcggtatccaccagcagcacgtcgtagaacttcagcttcgcttctttcagcgccgcattaacgatttccagcggtttctgggcaacgtcggacgggaagaaatcgacgcctacctgctgcgccagggtttccagctgtttgatcgccgccgggcgatacacgtccgccgacactaccagtactttctttttatgcttctcgcgcaggaatttacccagcttaccgacgctggtggttttacccgcaccctgtaaacccgccatcagcaccacggctggcggctgcgcggccaggttaagcacctggttttcttcacccatcgccgcaaccagttcgccgcgtacgattttgatgaactcctggcccggggtcaggcttttattcacatcctggccaaccgatttttctttaacccggttgatgaaatcgcgcacaaccggcagggcaacgtccgcctcgagcagcgccatgcgcacttcgcggagcgtttctttgatgttttcttcggtgaggcgtccacggccactgatgttgcgcaacgtgcgcgacaaacgatcggttaaattatcaaacattgtctctcgcctgagtcagaaacgttggccgcatgaagcgacacatacatacgattttgccgcagtataacatgaagccttctttcgccatattgcagcgcgacatgttatgccagctcacctcagctatccgctaaacggcccgataagcgccgtttagcggtgacttcactccacttttccagccagacggaccttaatctgcttatagtaatagtcattattaatgatgtatttacgcatcaacagggtaaccaacaggttaaaaatggccgggatgatggtcatcaatagcgcaatgcccatcaatgattgtgctgactgagtctgtccgggttgataatcaaagctgctcagcatcagtccgacaaagccccctgccagccccataccaaacttctggaagaataagatgccgccaaacgcgaggccggaaacccgcacaccgcttttaagttcaccgtaatcaaccgcttccgcaatcgccgcccagtagaccggcaattgcatatcgccgagcagactcagtaaaaaataaaagacaaatgccagccagatgtcatcttgtccgacgacaaaatacatcgcgacaccgaaagcaaaagtcagaaactgggtaatgcgaaacatcttaattttatcgtaacggttagtgatataagtggcgaaaaagatagcaatgcctgacgccacgacgcccatggtcagaaaggacgcaataagatcttcgccaccattaagataatatttcgcataataggcagaaacggaactgcggataatgccgccgaacataataatggcaatcgcaaggccaaggattaaccactggtcgtttttaaataaatggctaatttgctgtttaaaaataaagggctttaccggatgaacaatccgctctttcaccgtagcaaaacagaacagacaaagcagcgtggcggcaacggccatcacccccattgtcagtttatagcctcttgccaggtcattcccccctaaataaacggccagaatgggaacggcactggctacgaccagcaccgccgttttgttcatcacaaaccggaatccgttagcggtaagtcgctcctgtggatcgtcagtaatcacaccgatgagcgaaatataaggaatggagatcagggtataggcaagcgttaacagaatataagtaaagaatgcccatgccagctttccggcgtaagtataatccggtgtagaaaacatcatccagatcgtcagaccaaacggaatggagaaaaagagcagataggggcgataacgcccccagcgtgtttttgttctgtcggtaataatacctactaacggatcgcttattgcgtcaacaaaccgcacgacaataagtaaaatgccgacgtggctcgccttgagtccataaacatcggtataaaaataggtgacgatcatggccatggatcccatcaccaggccaatagccgtatcgccagcgccgtagccaaccttttcgctgaaagagagtttcatattattatctcgtcaatttgttgtgtcagatctattttttagtgattttctgccgtcgcaaaaagtgctccagggcttgccgcaattcgcgcgtcaacaggctgcattgtcagtggcggcgtgggtaatttttgataccagtacagggtggaggaaagagggttggcgtgaccatgctgcagggtgacgagaatacgttttttaaaatgaatcggatcggtgagatggaagcgatagcgggtctggatacctgcaacatgagagtcgtgtaacgacgagccgcaaaataagctttcccgatcctgtatcccccacgcctgactgaaataatcttccattcccgtcccctggatcctgcgctccagcgggggatcatcatcaataaatatcatctcatccccttcaccccactctgtgccctgccagtgacgtaccgagagattacagccgatataatgtccctcaccttcaatatctaaaagccggtaatgatactctgcactggtacagggaatattcacttccgggctgttgtcctgcaattccggtgcccagccacggcaggggtttccccgcttccaccatgcatggaagtaagccacatccgccgggtgtttatccggataacattcaaaatcgatattaaagaactgcccgtagggaatatcgttttgattttccacttcaataatcgcccgttcattaaaaggcatcggcaggtaacagttaaaggcggcgctgccgccattgcgataacgctcttccgggcggacggtaacggtaaagggcagcgaattgaaaccggcggagattgaatgaccgaggcaaaaaaaatcgcctaatggcgcgatcacggagggctgcgtctgattatcccagtatatttttaacagcaccttgcgataataatcggcatcatgttcttcccagctaaccccgagagcattattgatttcgttaatcgccccaacatattgcccggcgactggatcaattaacgcggcgcctttaagacggcgacaaaactgggtcatccagatatgcgtaatgcacccactgccctggatgtccgccagccgaatagtttcgccaggtggaatgatccagtaatcctgattacgtccactttgatcccaactggataacctcccgctacgggcgtttcttatccgacaaataccctgcaaaaatcctgacgtttgcgcagtcataactcacctttactatatttatcaaaaataataaaaggcgttaaaacggatcaatcatcttcccggaccactcaacgcctggaggaaaacccatgctaactcgagagagcaaattaaccagtcattatatagctggcaaattgtttcacgatggaatgtgattacactcaccaaaaaaggcttatatttaatcagtgaatatatttaaaggccattacggtatccctggtgccgcatgcaaagtctgatgcaacggttggagccagcgacacgtaacgttatactccctcttctgtcttgcttactgtcgacaccactatgcccgtttttgctctgctcgctcttgtcgcctattccatcagcctggcgctgattattcccggtttgctgcaaaaaaacagtggatggcggcgcatggctatcgtctcagccgtcgttgcattagtcagtcacgccgttgcgcttgaagcacgcatttttccggcgggcgaaggcggccagaatttaagcctgctgaacgtcggctcgctggtcagcctgatgatttgcacggtaatgaccattgtcgcctcaaagaatcgtggctggttgctgctgcccatcgtctacgcctttgcgctgatcaatctggcatttgccattttcgtacctaacgaatacatcacccatctggaaaccacccccggcatgatggtgcatatcggcctgtcgctgttctcctacgcgacgctgatcattgccgccatgtacgcgctgcaactggcgtggatcgattatcaactgaagaacaaacgcctcgccttcagcagtgaaatgccgccgctgatgagtattgagcgtaaaatgttccatatcacgcagattggcgtggtgctgctgaccctgaccctgtgcaccgggctgttctatatgcacaacctgttcagcatggaaaatattgataaagccgtgctgtcgattatcgcctggttcctctatatcgtgctgctgtggggccattatcatgaaggctggcgcggacgtccggtcgtctggtttaacgtcgcgggcgcaggtctgctgacgctggcctatttcggcagccgcgtgttacagcagctggcaggctaacgaaacaaaggattttcccctggaacatatatcaaccaccaccctcatcatcacgctgatcatcatggtgatcgtttcggcgtacttctccggctctgaaaccggcatgatgacgctgaaccgctaccgcctgcgccacctggcgaagcaaggcaaccgcgcggctaagcgcgtcgaaaagctgttgcgtaagccagaccgcctaatcagcctggtgctgatcggcaataacctcgtcaacattcttgcctctgccatcggcaccatcgtcggtatgcgcctgtacggtaatgccggggtcgccatcgccaccggtgtcttaaccttcgtggtgctggtgtttgcagaagtactgccaaagaccatcgccgcgctctatccggaaaaagtcgccttcccgagcagtttcctgctcggcccgctgcaaatcatcatgatgccgctggtgtggctgctaaatatggtgacgcgtctgctgatgcggatggttggcattaaagcggatgtggtggtgagcggcgcgctcagcaaagacgaactgcgcaccattgtgaacgaatcgcgctcgcaaatttcccgccgcaatcaggatatgctgctgtcggtgctggatctggaaaaagtcagcgtcaacgacattatggtgccgcgcaatgaaatcgtcggtatcgacatcaacgatgactggaaatcgattgtgcgtcagctgacgcactccccgcacggtcgcatcgtgctgtggcgggattcgccggacaacgccatcagcatgctgcgcgtgcgcgaagcttatcgtctgatgaccgagaaaaacgagtttaccaaagaagtaatgctgcgtgcggcggatgaaatttactatatccccgaagggacgccgctgagcattcagctggtgaaattccagcgcaataaaaagaaagtcggcctggtggtcaatgagtatggcgatattcagggtctgctgaccgtggaagacattctggaagagatcgtcggcgacttcaccacttccatgtcaccgacgctggcagaagaagtgacgccgcagaacgacggctcggtgatcatcgacggcaccgccaacgtgcgtgaaatcaacaaagcgtttaactggcacttaccggaagaagaagcgcgtaccgtcaacggcatgctgctggaagcgctggaagagatcccggccaccggcacgcgggtgcggatcgggcagtatgatattgatattctggatgtgcaggaaaatatgattaagcaggtgcaggtgatcccggtgaaaccgctgcgggacagcgtcggggaataaactggccgggtgaggcgttagccgccacccggcactaaaacccccgcttaagctttcgctttagcgacggtaaccatcgccgcgcgcagcgtacgaccgttcagcgtatagcctttttgcatcacgcccagcacgttaccggcagccacctcatcggattccaccatggcaatggcctgatgcacgttgggatccagcggcacgttagtatccgccacgacgcccacaccgaatttacccaccacatccagcatcgatttcatggtcagctcaataccttcgaccatcggcgccagatccgggttggatttatcggctacctcaagggcacgatccaggctgtcaaccaccggcagcagttcgttgataaacttctccagcgcaaatttatgcgccttctcaacgtccagctcagtacggcggcgcaggttttccatttccgctttgatacgcagcacgctctcgcgctcgcgattttgcgcttcggctaattgcgcttcgaggttcgcaatctgttcatcgcgcggatccacctgctcaacagaagcgtctgactctgtcgcctcgacctcttcgtgctgttccgtgataatttcttccggggcttgcccctcaggcgttttctgttctttactgctcatgaatttctccgcgtttttttgcattcatctcgctaacttcgcttattatggggatatgtttccgggtttcaagggaagcagcgagattgtcatcatcatccggcacaaggatctccagaatatgaataatcatttcaagtgtattggtattgtgggacatccccgccaccctaccgccctgaccacacatgaaatgctctatcgctggctgtgcggtaatggctacgatgtcattgtagagcaacagattgcccaggaacttcgtctcaaaaatgtgaagacgggcacacttgccgaaattggtcagcaggcggatctggcggtggtggtaggcggcgacggcaatatgctgggagcggcgcgtacgctggcccgctatgacatcagcgtcatcggcatcaaccgtggcaacctgggtttcttaaccgatctcgatccggacaatgctcagcagcagctggctgacgtattagaaggccattacatcgcggaaaaacgttttttgctggaagcgcaggtctgtcagcaggactgccagaagcgcatcagcaccgccattaacgaagtggtgctgcaccctggcaaagtggcgcacatgattgaatttgaagtctacatcgacgaagtgtttgccttttcacagcgctcggacggcctgatcatttccacgcccaccggctcgaccgcctactcgctctcggcgggcggccccattctgacgccgcagctggacgccattacgctggtgccgatgttcccgcatacgctctcggccaggccgctggtgatcaacagcagcagcaccattcgcctgcgcttctcgcaccgccgcagcgatctggaaataagctgcgacagccagatcgctctgccgattcaggagggtgaggacgtgctgatccgccgctgtgactatcacctgaatctgatccatccgaaagattataactatttcaatacattaagttccaagctcgggtggtcaaaaaaattgttttaatttcagcgccagggctttactggatataaaaccagtttatactgtacgaaaacacagttatggtttttcatacaggaaagcagctatgttggcacaactgaccatcagcaactttgcaatcgtacgtgagcttgaaattgattttcacagcgggatgaccgccatcaccggggaaaccggtgccggtaagtctattgctattgatgcgctcggtctgtgcctcggcggtcgcgccgacgctgacatggtgcgcaccgacgcctcgcgcgccgatctctgcgcccgcttctcccttaaagacactcctgccgcgctgcgctggctcgaagctaatcagcttgaagacggacgtgagtgtttacttcgtcgcgtgatcagcagcgatggacgttcccgtggctttattaacggtacggccgttcccctctcgcaactgcgcgagctgggacaactgctcatccagatccatggccagcacgcccatcagcagttaatcaaacctgaacatcagaaatccctgctcgatggctatgccggtgagtcggtgctgatgcagcagatggcggaacattaccgtcagtggaatctgagctgccgcgaactggcgcagcatcagcagctcagccaggagcgcagcgcgcgcgctgaactgctgcactatcagttgaaagagctgaatgaatttaacccgcagacgggcgaattcgagcagatcgacgaagagtacaaacgtctggctaacagcggtcagttgctcagcaccagccagagtgcgcttaacctgctggcggacgatgatgacgccaacctgcaaagccagctgtataccgcgcgccagctggtgacagagctggcgggtatggacacgaaactttctggcgtactcgatatgctggaagaggctgccattcagatcagcgaagccagcgaagagctgcgtcattactgcgatcgcctcgatctcgatccaaaccgtctttttgagctggaacagcgcatcgcgaagtatatttcgctggcgcgtaagcatcacatcagcccggaagagctgtcacagttccatcagaatctgctggacgaacagcaactgctggacgatcaggccgactcgcaggaaaccctgtcgctggcggtgcaaaaacaccatcaacaggcgctggctaccgcgcagcaactgcatgccgaacgcgtgaagtatgcgcaggagctgggtgggttaatcactgaaagtatgcactcactttcgatgccgcacggcgtgtttaacatcgacgtcagtttcgatgaccgtcatttaacccaggaaggcgcggatcgtattgagttccgggtgaccactaacccgggtcagccgttgcagccgatttcaaaagtggcctccggtggtgagctttcgcgtatcgcgctggccatccaggtgatcaccgcccgtaaaatggaaaccccggcgctgattttcgatgaagtggatgtggggatcagcggcccgaccgcggcggtggttggcaaactgctgcgccagctgggcgaatccacgcaggtaatgtgcgtcacccacctgccgcaggtggcgggttgcgggcatcaccacttctatgtcagtaaagagacggacggcgccatgaccgaaacgcacatgcagccgctggacaaacgcgcccgtctgcaggagctggcgcgtctgctgggtggcagcgaagttacccgtaatacgctggcaaacgccaaagagctgctggcggcctaaactttttcagcaattcagagtcatagtgaaacattaaatcgccgtaagaccggatactgctacacatacaccttcaggcagccaacgatgaggcagcctgaaggatgaagtgtatacacaaaagcattcaggttgcatcaaggcggcaagcgaacgaatccccgggagcatagttcactatgtgactggggtgagtgaacgcagccaacgacgaggcagcctgaaggatgaagtgtaattacacaaaagcattcaggttgcatcaaggcggcaagcgaacgaatccccgggagcatagttcactatgtgactggggtgagtgaacgcagccaacgacgaggcagcctgaaggatgaagtgtataaaggttttaatgtgactaaaggtctattatcatcggcatattaccaatgagccgcgtactgctctggcccgaaaaggaatgaaatcactatgcgctgtaaaacgctgactgctgccgcagcggttcttctgatgttgaccgcaggttgttccactctggagcgagtggtgtaccgtcctgatattaatcagggcaactacctggcacctaacgacgtatcaaaaatccgtatcggtatgacgcaacaacaggttgcttacgcgctcggcacgccgatggtgaccgatccgttcggtactaacacctggttctacgtcttccgtcagcaacccggccatgaagatgtgacgcagcagaccctgacgctgacctttaacagcaacggcgttctgaccaacatcgataacaagcctgccctgacttcgcagtaagggtacagaaaaacaaaaaggtgctcatgagcacctttttttatggcctgcgaaacccttacttctctttgtccgcgcttttttctgcccgcttgcgacgcagctctttcggatcggcgatcagcgggcggtaaatctcaacgcgatcgccatcgtgcagctcgtcggccagcttcaccgggcggctgaaaataccgactttgtttccggtcagcgaaatatccggccgcagttccagcagcccggaggcgcggattgcctcttcaacggttgcgccctcgttcagcgtaacccgttgcagatactgcttttccggcagcgcataggccacttctaccaccatcttacccggcactgtaaacctctttggcgcgatgggtaaaggcctgcaccatgttcatcgccagctctttaaagatgcggccaaacgccagttcaatgagtttattggtgaattcaaaatcaagctgaaactcgacgcggcaggcctcggggctgagcggggtaaacttccagccgcccatcagctttttgaaagggccatcgaccaggtgcatcaaaatgctttgattgctggtcaatgtattgcgtgtggtaaacgttttactgatgcccgctttcgaaacatccacggcggcggtcatctgcgtcggaccggactccagcacgcggctaccggtgcagccgggcaagaactccggataggacttcacgtcgtttactaactgatacatctgttctgcgctgtaaggcactaacgcagatcggctaatctgaggcatagcgttttcctgggatctacaccctataaataataacatctccctcccaggaaaggaaaacgcttagccgcaactcgtgctaatataacgcgttacacctcgcaggacggaatggggtgtttttataacatcagattacctatactgagcggcattatgaccaagaaaaaagcacacaaacctggctcagccaccatcgcgctcaacaagcgcgcccgccatgaatattttatcgaagatgaatttgaagcgggtctggccctgcagggctgggaagttaaatcgctgcgcgccggcaaagccaatatcagcgacagctatgtcatcctgatcgatggcgaagctttcctgtttggcgccaactttacgccgatggccgtcgcctccacccatgtggtctgcgatcccacccgtacccgtaaactgctgctgaaccagcgcgagctggatacgctgtatggccgcatcaaccgcgatggttatacggtggtggcgctgtcactttactggaagaacgcctggtgcaaagtgaaaatcggcgtggcgaaaggtaagaagcagcacgacaagcgtaacgatgtgaaagataaagagtgggcggtggataaagcccgcattatgaaacacgcgggccgttaaatccgtgcgtctcccctcaccccggccctgatttgccgggaggggggcgaaattaccgctcccgcaatgcctcgttgaccttgttcagcggcttgatcagataatccattaccgttttctgtccggtcttgatctccacgttcgccaccatacccggtaaaatcgggaagcttttgccgctcttgttatgcagctcggcttttgaggtgcgcacatacacccggtaataaaactgatcccgcttcacctcatcctgcaacgtatccggcgataccacttccaccttgccgcttaaatccccgtaaattgacgaatcataggccgtcacctttacggtagccggtaagcccggacggatataggcaatatcccgcggattgatgcgcgtctcaactaacagctgatcttctaacggcacgatctccatcagcttgccgcccggttgcagcacgccgccgacggtggtcacctgaatgtctttcacgatgccgcgcaccggcgaaaacagcgaggcgcgatccacctggtccgctttaccggacattacctggatctgcgcgtccagatcggcattgtttttcacctgctcctcgcgggcgcgcaccgcaaactggttacgggcatcgtcgattttgccctgcaactcggcggcctgccgttgcaggcggatcacctccacctggctcgccgcccctttggccaccagcggctgcgtcagacgcagctccgacatcaccagctgataggttttttgcagattcgctaccgtctcattgaggtttcgccgccgcgactcatacagctgccgctcacgggccaccaggtccggctcgcgcattgactcggcgctaaagcgcagcggctcgccggtcagttcggaacgcagacgctcgctggaggcgcgcagcgtgcgcacccgtgacgccgcctcgccgtagttcgactgaaaacgggtaggatcgaggcgcgccagcagctgcccgcgttcgacaatatccccctctttcaccagcaggccgctgacaatgccgccgtcgaggctgtcgatcacctgcgcgtggctggagggggtgatcttgccggtgccgaccgtcacttcatccagcaccgcccaccaggcccagacgacaaaaaacagcagaccgatcagcgtcagccagatcaccgaggagtaaaagcggccctggcgcgccagatcgtcctgcatacttaattgactcatggcgttctccttatgcgactgacgagacgctgctgttgcgcaccgcctgcttgatcagcgtatcgcgcggcccgtcggcaacgattttgccgttctccattaccacaatgcggtccaccagattgagcagcgccggacggtgcgtcaccagtaccagcgtgcgcccggtcagccactgggagagctggcggatcacccaggcctccagttgctcatccatcgacgcggtgggctcatccatcagcacaatctgcggattgcgcacgatcaggcggcttaacagcaccatctgccgctgcccgccggacagcccgcgcccgccctcgttaattaacctgtcgaggctggcggcatcctgctgcaccatgccgatcgccccgctgatgcgcagcgcctggatcagctccgcttcggtggcgtggggatggccgagcatcaggttttgtcgcagcgtgccaaaaaacagccgcgaatcctgggaaaggtaccccagctggcgacgtacatcgccaggatcgatatgcgccatatccacgccatcaatgatcactttgcccttactggcctgcgcctgaccggagagcagtttcagcagggtggattttccggcgccggttttgccgaggatcgccacgcgctcgccgggcttgatcgtaagttccgggatctgcaccgcctgctcgcccttttccacatcgtagctgtactgcacctgctgcatctggaaatggcctgccagcaccgggcagtgcgccattttttcccccgcggttttatccagcggttttttcagcagatcgttcaggccgttcatcgccgttttggcgtgctgccagcgggagaacaccatagtgagctgcatcagcggcgcgatggtacgcgacgacagcaaactacaggccaccagcgtcccggtggtgatactgccttccatcaccagatagcagccgaacaccagcatcccggcgtaggtaatttgctgcacggtggaggcccatccgctgagccgcgcgccccatacgcgctgcttcatgccgatccccgcgcctaccgcatgagtgtgttcccactggcgctggaaatagggttccgcctggagcgctttgatgtcttccaccccttcgatggactctaccagcaccgcgttacgaatggcgctttcgcgcatcccctctttggccagtttcgccattggccactgcaccaggatgccggggatcacgatcagcggaatagcgatcagcgggatcgccaccagcgggccgcccaccagcgtcataatgccgaggaacagcagcacgaacggaatgtccatcgccgcgccgacggtggtggaggtcagcagctcgcgcacctgatcgatttcacgcagctgggaaataaacgaaccggtggatttcggacgggcatcgtttttgatcgccagcgcgcgggcaaaaaacagcgacgagacgttgagatcgatatgcttacccataatgtccgacacatgggtacgggcgagacgaataaaaaactccagcagggcggcgaacagcacgccgataaacagcacccacagcgtggggatcgactgggccgggatcacccggtcgtacacctgcatagagaataaaatccccgccagcgccagcacgttgccgagcagtgaggcgagcgcgatctccgacagcttgcgtccgctgtggcgaaagtgccgccagaaccagtgcgcttcccagggtttggtgaaatcatcaatgcgcgcatcgcggccacgggcggcaatgcccagcatcaccacctccggcctgacgcgggtgagcagcgtttccagcggctcttcgcgcaccagatcgcccccttccgacaaccagtaggtcgccagcccgtcggcgtcaatagactccagcagcatcaactccccggactccagctggacgatcaccggcaggttttgcgcgttccagcgcatacgctccagcggcaccgtgcgcacctgtagccccatcaggccgcttaagcgctccagccgggcgctctgcggcagcgcttcaaaccagcgcatttgctggcgcaccgcgggggcatcggcaggcaggccgaatcgacccgccgcgcgcaccatgacattgatccagctttcggtatcaggctcttgcattactgctccttaaagtgaaggcagggtatcgccaatagtgcggctgcgttcaatgcccagcatatccagcagattatctgcggcgccggcataacggacggcggcgtcccaggcgtcatagcgcgcagtgatcgaggccgtgtctgcctgaaagacatcctgttcaatactcagaagatcgttgaggctgcgcttgctgagacgatactcatcgcggtacacctcgcgggcgcgatcggcgctgataaactgcgcgtcccctgcccgctggcgctgctgcgccccggtgagatccgcccaggcggtggcggcgcgctgattcatctccagtttgctggcctccacctgggcgcgggcgttggcgcggtcgccttctgccgcatccacccgcgcgctgaccgcaccgccctgatagaggggcgcgtccacgacaagctgcacctgatcatcccagtagctgctgttttcgttctgataacgggttcgtcccgcctgtaccgacaccgtcggccagtgctgggcctgcacctgacggatgcgctgttccgccgccagctgtttcgactgggcgctgcgcacggcattgctgcgctcgtacggcagcgatttgagggtaattttttgtttcatcagatcgtcaggcagatccggcagcgtatccgacaccacgccggtcagcacgctcagggcagcctgcgcggagcgggtctgggcttcgtactgtgcgagcgtggcgttcagcccggcgatgcgcgtctgcgcctgtaagacgtcagactgcgagctcagcccggcctgggcgcgcagatccgccatctcctgcaccgccttcagtgaggcgatatttttacgcgccgcgtccgccagcgcctgatgacgcttaacctgcaagtaagtttgcagcgtctccatgccgacttcattaagcgcattgtagagatcgtaacggtaggcatccgacagctcatgctgctcgtcaatgctgccgccggttttaccaaagtcgtaaatcagctgttttaagctgacgccccccgcgccattactgctcagcgagcccgccgaatcggtacggtgcgaacgtccgacgttcccctgtaaagacacctgtggaaaccatgcgctttccgcttcggaaagattggcttttcccacctggatttgcgccgccgcctgagcaatttttggattgcgggcgaaggcgcgcaaaatagcctctttgatggtcagctgcgcctggaattgctcgccgggcgcggtctgccactgatactcctcagcccaggctggcagtatcgctgttccgggcactgccagcagcaacagccctatcgtcgctaatttcatgatcccacctttggctgcccgtggtgatattttacgttccctcgcctcgtccctgaggctgcgatccggtcatcagaccatattgacgtgcagaccctgctgcaccagtacatcgcctaaggtgttgctttgtgaactgttgtggtagatgtcgaactgcataccatccacctcccgctggccgctgatcgcccagatgtcgctgttgccatgcaccagattcacgctgtcgcctttactccccttgatgatcaggtcatcttccggtttatcggtcaccgtcagcgcctcgttcagatccagcgtgatgctgttggtgcccgatttgcccagatcgatgatctcgatattgtgcacacgggtggcggcgtcgatcaggttaagtaccagatccacgccgtcgagcaccagggtatcggtgcctgccccgccgtcgatctccacaaagcccagggtcgcaaggtgaatggtgtcattgccctcgctgccctgcacgctatcgccgctggcttcggtgccgtccgccagggtgatgctgacgcctccaatagtgtaggccgcctcctccgtctggttgagcgtactatcactttcggtagtggcagccgtcgcggtagcgcgtgcggtcagggtgctggccggtgcgctgtcagtctcctgtacggtgttgatactgtctgaatgcagcacgaagctggagtcatccgtcgccagcgccatcagagtggcaggcggcgtggtggagatgatattcccgcccaggccgacgttcagatagccggtgttgccagcggcatcggtggcgtacaggttaaccacgctggtgagcgacaacaggttcaggatgttcagaccgaggctcagtgtggtggaccagttgccgttggcgtccgttatcgcggtggtgcttaccgtgccgttgagcagcgacagatgcaccacggcatttgcccccagattgcgcgaaccgccgcttaacgttaaccctttggtcagcagcgtcagcgggttcagggttgccagcgggttccaggtcagctccggcgtggtaagtttgacggtcacatccgtgctggtgctgttggtgttgccgactttatcaatgaccgacacacccactttcagcgcgccaccggtcaaccctttcagcaccgtgctgctgaccggtaacgaccagctgccgtccgggttcacggtggcgttataactggtgccgcccagcgacaccaccacgcgcgagccgtcggtgatgccaccgttaatgcgcccggaaatggtctgcgtaccgttcgactccgccacgttcaggaagccatcgttgccgaacagcgaggtcagcgaaatagacggcaggctgtgggtgatcacgttcagcagcccgctggtgcccgcgacgttgcccgccgggttggtaagcgaggcgttaaccgacaaggtgccgtcgagcaacgcgctgagatcggctttcggcaccgagaccgaccagttgccgtcggatcccaccagcgcctggtaaaccttgttgccgagcgtcacgttcaccagcgagccgaccgcattggtcgccgagccggtaatggtctgggcgctgagaatatccgtcgcgttcagaccaccgtcgccaaacagtgagttgatcaccagcgtcggcgcctgctggatggctaccagcagatttttggtatcggtggcgacgttacccgccacatcccgcgcggtgacgcccacggataacgtaccgtccgtcagcccctgcagggtggcggtcggcagcggtaaacgccaggagccatcactgccgacggtggtgttgaaggtcaggccgccgagggtgacagtcagggcagtgcctgccgccaggttagtggtggtaccgttaagcacctgcgcgcccagcagatccgagaggctcagattcccgtcgccgaacggcgtattgaggctgacagaaggcagcgcgttgatcacggcgttaatcagttgcgagctggagccagggtttccaacatcatcacgcacgctggcgctaacggtgacgttaccgtccgccagtccctgcaatacagatggcggaacgttcaccgaccaggtaccgttgttgatggtgcccgtcagcgtggcagtgccgacgcgcacggtcaccgtgccgctggcgagactggtgacgccgctgatgatctggcctgcatccgcttccgcccggctcagataaccgtcgccgccaaacagcgtgcctgtgttgacgctcaccgtcggcagaccggtcagccccactttgatggccgggccattggtggtggtggtattgccgtccggcgtctgaatggtgatcacaggcgtcagcacgccgtccgccagcgaagctaaatccgccgggctgacattaatgctgaaggtaccgttacccgccagcacaccggcgaaggttttggtaccgatctgcacgctcaccgtggaaccgaccggggcctgcgcgacgctaccggtaatggtctgcgtcagcagcgcatcggcggcgttcagcagcccgtcgccaaacagggtgacggcattcagcaccggcgcgagcagatccagcgccacgtttgcgcccacggccgcattgttaccgtactgatccgtcgcctgcacgcttaccgccacgttgccggtgcccagcccctgaagcgctgcctgcaccgcctccggcagggcaacggaccatttcccgttgccgtccacattggtcgtgaatgcagtggtatcgccgactttgatgctcagggtgcggccattcagcccggtcgccgtaccgctgatcaccccgcttaacagttccggaatgctcagcataccgtcgccaaacagcggatcgagcacaatagaaggctgtgcttttaccgccaccgtcagatcggtactgccattcactacgttgccgaatttatccgttacgctgaccgcaaggcctacggtaccgtccggcagcgcgccgagtaacgatggcggcagcgtggcgatccagttccccagcgcatcctgcgttccctgaatggtacgtccggcaatggtgaccaccacgcccgcgacgttggccgcattattcagccccagcgacaccacctggctggtggtactgtcgaccaggttgatgatgttatctgccgccaccgtaatatcgccgatcaccggcagatcggtcagcgccgtgccgacgttgatgatctgattagtggagttaccgtaaatatcggtgacatccacctgcaattgcagggtttgctgcgtcagcccggtccacagatcgggcggcaactggatgctgaatttgccatcggcgcccaccgtggtggtcgggatagtggcgctcaccccggcgatggtcactttcaccgtcgcgccgcgataatcgccgcttacttgcccggtcaccagctgcgtgatcagcgattccgccacgttcagcacgccatcgatgccaaagacatcgttgaccacaacgccaaggccctggttgagggcgacgttcagcccgacattgttactggacgtattacccgccgcgtcggtggaggtgatgttaatcacctgagccccgtcggtcagcgtgcgcagctccagttccgggaaggtatggctccagttaccgttactgtcgaccgtactgctccagctgagcggcccgagcgtcactgttacagtgttccccggctcgccgcgtcccgccaccagcataccggtggcggcttccacggtattcagcaccgccggcacgctgagcgcgttgacctccagcagcggctcatcgcgttgcacgctgatgatcctgccgtccaccgccgggttgcctgcgacatcgcttagctgcgccgtcaccggcgtactgcccgacggcagcgcggcgacatccgcctgcggcaccaccgttgaccagttgccgtccgatcctacaaccgcatagtaagtcttgccgttgagggtcaccgacaccgtgcgcccggcttccgacaggctggcagtaccgcccagcgtcaatggctgaccgctttcggcggcgttaataatatcgtcaccggacaccggattcagggtcagcgtcggggcgagcgtatccacctgcaccaccaccgaggaggtggagttcggcgcagcctgactggtggcttcaatggtatagctcgtctggtccgggaaggcgctgaccggcacgctggtcgtccaggtgttgttgccgtccaccgttgccgttcccaccagcacgccatttacggtgatgttaagcagcgtacctgccgggtacccattgctctggccgttgaccgtgatcgcaggcccggcgctgaactcgctggcgttgataatgttatcgcccgccaccgggttgaccgtcacgctgaaggctggcggtacggtatcaatggtgacgcccaccggcccggtggtggccgggttgcctgcgatatcctgcaccgttgcctcaagggtcgtactgccgttggcgagcgtcgccatctgcaacggagtgagctgtagcgcccaggtattgcccggctgtacggtggtggtaaaggtctgtccccccagcgtcacggtgatggtgcgccccacctccacattgctggtggtaccggtgagggtttgcagctgctggctttccgtccagtcgagatcgctgttgccgaacggcgcgttcactgaaatggtcggctggttaagggcgatcaccaccggcgtgctggtgctgccggtattccgggcatcgtcagtgatggtgacgatcacgctctgctgaccgcgatcgacaccgatccagctgtcgctgtccagcgccagcgtccaggtattggtcagcggatcgacggtggcgtcaaagattttgccgccgatggtgacctgtaccgtggtggccgccggatcccttgaagtaaaggtgcctgacaggctggccggcgcggtggattcgctgatgttgagataattatcgccaaagatcggcgtgttcaccgtcacggtcggcgcggtaaaggcgacgtcaaatggcacctgggcggtctgcacgttaccgtactgatcttcggcacgcacgacgatagtgtgcgccgtcgccggatccagcccctgcagggtgccagccggcagcgacaccgtccactgccccgcgggatcgacatcagccacataggtgacgccgtcaacatcaatggtcacggtgacaaactgattgccgccgctcagacccgtgctgccggtcagcgtcagcgggcctgccgcctcgctgatattcagcgtctcatcgccgccgaacaggttagtcacgcccggtgtcggcaatgccagctgcggcacaaaggtctgggtggcggaatccacgttgccataggcatcgctcaccgtcaccaccacggtctgcgtctggccgttggttaagccggttaacgccgacggcggcagggtaacgctccactggccgtttgcatccacagtcgcgccggtattgtaaggcacgccgttcagggtgacggtgaccgtctgccctgcaccaatgaccccggtgttgccggtcagcacctggcctgcagccgcttccgaattattcagcacgccatcggtaaagagcgtgcccagcgtcacctccggcacattattgatcacggcctggaagttaccgtcgccgttcacgatattgcccgccgtatcggtgacgatgattttcaccggaatggtgccgtccggcaatgtgcccagcgtcccggcgctgactggcagggtccactcgccgttcgcgcctatattcgcgtcggtgatggtgataaagggaccgttattaatactgacctggatggtctgaatactggctttatccagcccggtggtgccggtgagcgtactgtctgccacttcactgctgatcagcacgccattaccgaaggccgtatccagcgtcggcgtcggcagcacacccgcgcggacgtcaaagtcctgagccgggctggtgtcgctgttgccggctttatccgttacggtcaccgccagggagtaagcgccgtcgctcagcccggttaagaccgtcgatggcagctgtaccgtccagttaccgttattatccacggcgccgttaaccgtgatcggatcggtcaggccattgccggtaatggtgatcgccacggtctgcccgccgccggtgaggccggtggtgccggtaaggatctgcccggtgctggcttccagctgattgatgatgccgtcagtaaagagcgtcgcaggcagcgtcgcatccggggccgcgcgcaccacttcgatccccagattgccgctggccgggttagcataggcatcggcggcgctggcagtaatggtgtacggaccgttagcaaactggttaaaggtgcccggcgcgatggtcgccgtccagttgccatcactgccaaccgaggcagtaccaatctgcacggtaccaataaacagcgtgatcgtcgccccggcaggcaaccccgttgaggtaccggtgatctgccccacatcggtcgcttctgcggtgtttatcatgccatcggtcagcatcagcgtattgccgatggtgatggcaggcagcgtcgtgttgcccacattaatcggcagcggcgtgctggaaacgttgccgtccggatccgtggcggtaagggtcagcgtggacgggccctgcggcagcgcctgcaactcctctgccggaatgacaatgctccattgacccagctgatcggcccgggtttcgacaggggtaccgttgatcgtcagcgatacgatggagcctggcgtggtggtgccgctcagggtctgggcgacggcggattcactgatgttaaccagcccatcggacaggaagctgggatccagattgatgtccggcccgacggtatcgacacgcacctgctgcgtgctggttgccgggttgctggccgcatcgctggcggtggcggtgaccgtataagtctgatccgccagcccgctgaccacgctggcgggcacctgcaccgaccatctgccgtccgcgccaatgctggcggtatagctgcctccgcccggcgccagcgtcaccgtcaccagtgtgccctgcgccagattggtggagacgccggtaatggcaactgcgccgctgctttccggatcgctgataacgttatcccccgccacgctgtcgatactgagcgtcggctggctgcctggctgggtgataaaggtaacgttctgcgtggcgtcgtcgacgttgcccgccgcatcggtgacggtcacgcggatcggctgcacgccgtcctgcaccgccgccaggtcagtcgccggaacagccacgctccagctgccgtcggcctgcacggtggccggatagtcaacgccattcagcgtaacggtaacgatctgcccctgttccacattcaccgtcgagccggacaccaccagcggcgaaccggcttcgctggcattaacatagttatccgttgagatactgttcatggtgacctgcggcgcattcaccggcgaggcgtcgagggtaaagctctctttgatggtggcactgttccctgcgctgtcagtcgcgatgaccgtcatgcttaccgggccatccgggatgccgctcagcgccccggcaggcagcgtcacgctccagtcgccgttggcctggatcagggcattataggtctggccgttaatctgcacgacgacggtttgcggctgcgccggatcgtaaggcgtggcggtgccggtcagcactatcggtcctgccgcttcggcggcattcaccgtgccgtcgcccgccacatcgcccagggtgagtaccggcggcgttttgtccaccaggatgctgctttccagcaccgccgcgttacccacgccatccgtagcggtgatcaccaccggcacggtgccgtcggttaaactgttcagcaaggtggaagggacgttcaccgaccagttgccgctggcatcgacggtggccgtcagcgtctgcgcctgagcgccggagccgatctgtacctgtaccagctgacctgcgccgctgacgccggtcgtaccgctcagcgtgccgcccgtcagcgcctcgctgctgttcacaataccgtcggtaaagggctgattcatggagacggtcggcagggtggtggtgacaatagtgaactgatgactgttactcacgacatcgccgctgccgtcctgggccgatacggtgagggtggcggtgccatcgctgatggcgcgcgcctcctctgccgggacggtcacgctccacgccccgcctgcgccaacggcgcccgcgtatagcttgccgttcagcgtcaccgtgatcggcgttccttccgccagtccgacggagctgccgctgaccaccaggccactggcgttattaatatcgctgaggctcacccgatcgtcgccggtgagcggcgcaatggagatcgcgctgacagtggtgtcaacggtaaacggacgggtggcgctggtgctgttacccgccgtatcgctgacctgtacgctcagcgcatagtcaccgtcaagcagaccggccagttcgcccggcggaatagtgacctgccagctgccatcggcgcccacggtgccggtccagctggagccgccctgggtgacggtcaccgtctggcctgcttcaacgttcagcactttaccggtcagggtgatggcttcgccgcgttcggcggcgtcaatcacgttatccccggcgaccggatccacggtaagcagcggctgtttctgcggatcgatgcgcacgctgatgttatggctggcggtggtgctgttttgcgccgcatccgtcacggtaacggtaaaggtcgcctgcccgtccggcagcgcctgtagcgccgaagacggaatatcgacagaccatacgccgttcgcgcctgtcgtggtggtgtaagtctggccgttaagcacaacggtgaccggctggtctgcgcccgcgccgctggcgacgccggagagcgtctgggtcgcgcccgcttccgccaggttaagcgtgtcgttagtggcaaaaggatcaaaactcagcaccggcggttcaacatcaatgttgacgttgatcggcgtgctggtggcggtgttaccggcaatatcagtcaccgttaccgtcaccggcagcggcgaatcggtattggttaagctgtccagcgcgccggacggaatggtcacgctccactgcccgttctcattggccgtgccggtaaaggtattaccgccaagattcacgctgaccgtctgccccggcccggtgacgccggtttccccggtcagggtctggttctgctgaatttccgcgccgttcagcacaccatcgccaaacagcgggtcagtgtttgcctgcggcagcgcattgaggatgagattaaccgtatgggtatcgctcaccgtcacgccgttaaccacggcggtcgccgtgatggtcagcgggccatccgccgagccggacagcgtgcccggggccagcgtaatgctccagttgccgttagcatcgacaaaaccaggataggtcacgccgttcacctgcacctgcacctcggtgttgagcggcagaccggcgctggtgccgttgatggtcaccacgcccgctgcttcctgcacgccaatatagtcattgccggagatgatgctgatcgccaccgccgtcggggcgctgtccaccgtcaccggatagatgctgttcgttgtctggccgtaaatatcggtgacgctgatctgcaccgggttttcccccggcgtcagctgatagagcgtgccggacgggatcagtaccgtccagctaccgtcgctggccaccacagactggtacgtattaccgcccagcgtcaccactacccggctgcccgactcggcatcggtcgtggtaccgcgcagtaactggtcagttttgatttctgccgcgtccagcccgttattaccggcaaaggaggtgacggtggcggtcggcggcgtggttttgacgttgatggtctgctcaataacgtgtgggttaccggcggcgtccgtcagggtgacagtcgctaaattcgcgccgtccgccagttgccgtcgctgcccaccgttgtggtgtaggttttattgttcagcaccacggtaaccggacgcccggcttcctccaccgatgagataccgctcagcacctgtgcagtattcatatcttcgaggcccagacgtccgctaccggcaaccggcagcaccgccagatccggcgccagggtatcgacaatggcgctgcccggcagcgttgcggtattgcccgccgcatccgacgcgttgaccgtcatcgataccgttccctgcggcagggtttgcagatcggcaggcggcacggtgatcgcccagttgccgtcgctgtcgacggtggcggtgtaggtttttccgccaagcagcaccgagactttctgccccggcccgctgatgccggtattgcccgcaatggtctgcgccacatcccgctcgcctgcgctcagtataccgtcagcaaaaggcgtgttcagcgagggttgcggaacatggttaaccgccacgttcagaatatgttcatcagaggcagtctgcgtgccgagcgtaacggtggcggtgatttcacgcgggccgtctttcagctccgccagatcttcggcggggatcaccgcgctccagttaccggcgttatccaccacggcgtcgtaaactttgccgttgaactccaccagcaccgacaccgccggaccaaataccgtggtgacgccgcgcacttccagcggctgggtcacttccgccgcattcaggtagtcatcggtggagacaatagcgatggcgatgccggtctgcgcgctgtcgaccgtgatcggatggttgctggtgatagtctgattatttttatccaccacgctgacggtgatggtattgctgccattggcaagcgccagcagatcgcctgatggcagcgtgacgctccagctgccgtcgccctgcaccaccgcataccaggtttgtccgcccagggtgatagtcaccgtctgcccggcggcgatattttgcgtattgccggagagcgtttgatccagctggatctccgcgctgttaagcacatcatcgccggtgagcgggttaacgctgattgccggcgcggtgaggttaaccgtaaaatcactgctgccggtggtaatgttacccgccagatcggtgatttcgtagctgatggtgtagctttcgccatcgctcagcgcctgaagatccgtaagcgggatagtcgtttgccagttgccgttactgtcgacgatggcgaagtaatttttaccattaagggtaattaaaacggtgctgccttcatcagcagcctctgcatagccgcgcaggattttatccccgccaagctgggaactgtcaaatacctggttcggtacgaacggcaccgtgtccagcacaggcggaacagtatccaccatcacatccattgaagtttcaacggtgcgtccgcggaaatccagcagtcttacgcgcagcgtgctcggcccctgcgacaggctttgcagcacttccggcgggaacataaatgcccatgagccgtcgggattaacggtcgtggtccagacgttgtcgtcccacatgatggtaatgacactaccggcgttcgccgcctcggtcgaaccgctcagcatctgattgcgcgccaccagtagctgattgagcaggttatcctctgtcagaggttcaaccgtcagggttgaggttcctggcgtgctaccgccgccgtcaggaggtgtggtaccgccgccgtcagggggagtcgtaccgccgccgtccggcggagtggtgccgccgccatcagggggagtcgtaccgccaccgtccggcggagtggtgccgccgccatcagggggagtcgtaccgccgccatccggtggagtggtgccgccattgttattgtcgttatccccaccaccgccactaccaccggatgcggcagcaatacctacaatcccccccacggcagccagcccacccagtaccgccagcgctgaaataccgcctgcgccaatcaacgagtcgactgcgacctctgacatcgccgggacaatggcttcagcggtcattggcccggcatcggcggcaaacgggaacaccgcgtggtgcgcaccgagatcatcctcgaacaccagctcactgtgcagaccattttcatcaaggaaaaagaagcgctgatagcgaaccgtagagccatctttcatatggacgatcaggtcattgccttcgcgctcgtaaaagtttaccgaggcgggagaagcatttacgcgcacaatacttgtctgcgagagattaacgacgcgatcggcgttttgcggatattccatcacgatatcgccggtcttttgatttataatatccacggatccgggaaggccatttttcggcgccatattatattcctcttgcagcaagtgccttatgtcacgcacctgacgtatttattttgggtaagccaatggcagccaaagttatctggcagaattgggctcggtatggtttctggagcaatttatgaggcaaaatgttgattttactgggcttgatttttcatccattgcagaaatacgaaaatcatctgcttaaaatatataatcactttttcgtaataggcaaattccaatatcacaaattcatacatatttttttgggaaacaggatatatcctttatcactaaaataaaggttaagccctacttaaatgaacactcaagtgattacttagaatttgaataatgcaatgtgaagctaaaaagtaaattagaatatatcctgtatcctgttattatgataattaccatcatttattatttaatattcaggagcgcttcagacggatgaagcgctgcttacactctgtcactaccgtgctgttcacactttgagcgaacgcgcttctccagcgtccgacaggcttatggagtggtgtgctgggtcaaaaatctgttatactcagttcaacacattggggctgattctggattcgacgggatttgcgaaacccaaggtgcatgccgaggggcggtttgcctcgtaaaaagccgcaaaaaaatagtcgcaaacgacgaaaactacgctttagcagcttaataacctgctaagagccctctctccctagcctccgctcttaggacggggatcaagagaggtcaaacccaaaagagatcgcgtggatgccctgcctggggttgaagcgttaaaactaatcaggctagtttgtcagtggcgtgtctgttcgcagctggcaggtgaatgtaaagacagactaagcatgtagtaccgaggatgtaggaatttcggacgcgggttcaactcccgccagctccaccaatcatgattggacagtgcaaggacagcacctttaaaaacaggaagttaggtatcacggtaggactctgaccagacagtaacgtgaccaaaaaggatacgcaaaggagccgcggctccctagtgacaaaaaagcccgcatgtgcgggcttttttgtcatcctaaagttcacggcgcatttgccgatatttcatttattgcacccatacattagtacgatcttaagattgtaaatattttcttagcttcccttttcagcgtgacaagtgcattggcgatggtacaatttgcatcccatgcaagtggaatcaataataataattaataaaaatcaattgattactaaagaaaaaggcatccatgcaacctaaagcgcaggtagattcacaggcggttaacaacatcttatgggactacatctcgtctcataccattcctacgcaggctgaaattgacaaatttgaaaaagccataggccatgaagccgaacccatgcgctcataccttaatgggcttctcatggcatctctcaaagattttgatgctgcaatgtcctgctttcagaaagcgttgaaaaccgaaagtgagtttatcgcctcgaattaccttgcatatctcggcttttgcgcccataacaaattgcatagacaagaactattccgtttagaagagctctactgcacttctgaacatagaagagttgcacgcaacacagctttcactatcggtaacactaggttaattcgaaaatataaccttaaattgttagctttgtacgatggtgaagagcgtcagcaatacctggatgaaggcgctagaatgatttctttagttgaagagtttaagaaggcatcaactcttacgtctggggagattgaaactctttgcgacgaagttgaggggattgccaaccgccatggtgtaaactgcgttggcgctagttacttcgtttccactgaagaagataatgcatacattgttcgtgcagaaactgaagacccctatcttcttgcggaattaaatacagagctttcagaccttctcgctgatgaaaaataccttggaaaaccattcacttcttggttcaaaagtgacagaagcaggaaggaggaggctcaatgagcattaaaggcagagaatttatagagtttgcaggacgttgtattgaacaaggcgatgagattggttacagaaatgccattgggagggcttactatggcgcttaccatgaggtttcaggaattctcgaaaaagcaatcttcgtgcatactcatcaaagtatcagagactatttattaaaagagtcttggcttaaaggtaatgagccctttgataagatgaggcttatctctcttggatcaagacttaaacaaatgcatacaaaccgaatctctgccgattataatttggatgaaaactttagcgatgtagatgctcaggcagcgttgattcaagccaagaagttcattgaggatttggactcaatgtacaaacaaacatatcccgatcctttgaccgcaacttaagtcatcaactaggaaggtgcggagattcaatcctctcgtgctgaccaaaaattccagaaaaaccagccttttaaggctggtttttttatgcttgaaatttgcttggggaattactggggaataatgggggaaaaatccccgacgatttacagctagtgcgccctgacgaccggcaaatctgtccacctcgtcgtatagcatggtgacagcatttccctcttcatctgccatgccggctggacgccctgtccggcaaaatatagcgtgcccctgccctgtttattgagcctgtccatcagcatcatcagcgcgtcgctgtcggcccgcggcgcgttgtcatcaaacagattgagttgcgccacgccctggctgaaaaagtcgcccagcatgatccccgctttctggtaccggtggccatcgcgccatattgcatccaggcaacgcgtggccgccgcgatgatgtcacgggtatcctgcgtaggtgtcagcagtttagtgccgacgttgttgccgtagtaaggctcgttcaaagcaaagggcgacgttttcacgaatgccgaaatgtaccggcaatactgtcgttcgctgcgcaacttttccgccgcgcgggccgcatatgagcagattgcctggcgcatttcgtcgtagccggtgatccgctctccaaatgatcgggagcagacaatctcctgcttcgccggtgcaaattcttccagctccagacaggactcgccgcgcagctcccgcaccgttcgttcgagcacgacgttgaagtgtttcctgataaaccgaatatccgtgtccgccagctggatcgctttgctgatccccattgcttcgagctttttggcaatccgcctgccgacaccccacacttcttcaaccggcatcagcgccatcaaacggcgctggcgctcgacgttcgataaatcgaccacgcccccggtctggggatactctttcgcggcccagttagccagcttggccagcgtcttcgtctgggcgataccgacgccgcagcgcaggcgcgtatggcgccagacggtatcgcggatctccctcccgaaatcacccaggtcgcggcagttacgcacgccggtcaggtcacaaaaggcctcatcgatggagtagacctccacgcgcgggcatatttcttcgagggtggtcatcacgcgctgcgacatatcgccatagagctcgtaattactcgagaacgcgagcaacggctgcgggaaaggcgtctcgcgcagctggaaccacggcgtgcccatttttatgccgagctttttagcttcggcggatcgggcaatgacacaaccgtcattgttgctcagaaccacgatgggccgcccggccagatcggggcgaaatgcagtttcgcaactcgcataaaacgagttcatatcaacgagggcgaacattgcggtgcatcgtgttgatgacagaaatgacaacgccggcgatgtctaacccgtcggcgtcataaattgggatcggagggtatgccggattctcagccagcagttgaggcaccgggtgcgtcaccagtcttttgacggtgaattcacctccaagattggcaacgacaatatcgttatgctggggagtaaggctgaagtcgacgagaaggaatgagccatcaagaataccggcgccgatcatggaatcaccggagacgcgcagtgtgtaggttgaggaaggatggggaataagatgcgacaccagatcgatgccgctctcgatataatcagctgcagggctggggaagcctgcagaaacgagatccccgtacatgggaatatgtaccggaacctccggaaaaataaggcgttgtagctgcataattacctccttttaaattactgtttttatatacagtagttttaatcagaaagtaacgcaagagtttcacgttataccaccagcacaaagcttcaccgcttcgcttgtaagtttttctcgcccatggaattgtggcaattgtaaattaaattttgtgctttttttgcatgcaactaaacctgtttcgaagctggaaattttttgtacaaagtgcatacggccacgtcatagatgatggccacctgttttctgtccactccgttctctataagcctcccggcctgtgcccattgctctggcgataatttcggacgacgtccaccgattcgaccctttgcgcgagccgctgccagcccggcacgggttctctcaacaataagctctcgttccatttctgccagggcagacatgatgtgaaatatgaagcgtcccatcgggctggacgtgtcaatgctgtctgtcaggctacgaaaatgaactccgcgctgacgcagttcgtccaccaataaaaccagatttcgcatactgcgaccaagccgatccagtttccagaccaccagcgtatcgccctcttttaactccttgagcacccttttcagtgctggccgatttgcaacagtaccgctcattttatcttcgaaaatctgttcacatcctgcgcgttcaagcgcctgacgctgcagagcagtgttttggtcatttgttgataccctggcatagccaatttgcatatttttcacccgataaattttgccaaaaaatcaggtgaagttatctgcatggtatttgaagagcaatctctcaaatgtcggtttagccgcatccggaatgaataccgacattacatcggcaacaggcctcacgactacgatcatgcgtgatcagtgggtacctgataaggcgttaatcgttacgctggatgctggatctaacgt

SEQ ID NO: 8 - DNA, 43907 bp, Enterobacter sp SA187
cgtatgttcactccagagacttggtattcatttagcgtccgaagacgtttaagaatccatgtccttgagtgcccacacagattgtctgataaattgttaaagagcagttgcgacgcgctttagcgctgtgtcgcgaggtggcgtatattacgctttcctccctcagagtcaagcgtttattttcgcttttctctggcggccttcccggaggaggcctcctgacccgctggcctgtaagccgttgttccgtgtcagtggaggcgcattatagggatcccatttttttgcacaagccttttttggatctttttttctgagtgctgatttttcactcttatcgctgtgatcctgttcgatctgcgcaaattttgaggtgtaaaaggcttgcgccgtgcgaataatggacccaaagtcatcattatccttcgcaagtactgaggtatatatgtctgctgtcttacgtccttataaggatcttttcccaaaagtgggacaacgcgtgatgatcgatgccaccagcgtcgtcattggcgacgtccgcatggctgatgatgtggggatttggccgcttgtcgcgatccgtggtgacgtgaaccatgtcgagataggcgcacgcactaatattcaggacggcagcgtgctgcatgtcacgcacaagtctgcttataacccggcgggtaatccgctgactattggcgaagacgtcaccgtcgggcataaagtgatgttacatgggtgcaccattggcaatcgcgttctggtcggcatgggatcgattctgttggatggcgttgttgtggaagatgatgtgatgattggggcaggtagcctggtgccgcaaaacaaacggctcgaaacgggttatctctatctgggcagtccggttaaacagatccgccccttaactgaggcggaaatcgaaggactgcaatattcagctaataactacgtcaaatggaaagacgactatctggctcagggtaaccagatccagccctgatcgtcttcttgctgatcgtggatcagctgttcagcttcttcttcaatatcccagcggttagcctgaaaattatgcaaccactgttccggcgtatcgcctttaaaacgatacgccagcgagctgccctttattgcgcaggtaagctgcataccatttaccagcacgggaaagcataccgcctgcaattctgcatgccactcttcgcgatccggaaactggatggcctgattcattgcgctatttcctgcttcagctgattaatcaccgcttcagtttccggtaacaccccgtgccataacagaacagcatgagcagcctgcgccaccagcatacccactccatctgcgcactgttttgcgccatgatgctcacaccagttcaaaaacggcgtatttcctttctgatagaacatgtcataacagtacagatgcggatgaaccagcgattccgggatcgcggggatctcgccgctaatgccactggatgtcgcattaatgatcagatcaaattcatgatcccgtagttgatccattgccaccgccttgacgctgccggtatgcatgaagacgtttgccagcgcctcagcccgcgcaaaagtacggttagtgatggttacctggcaatccagagacagtaaagggagaagaaccccacgggcagcgccgcctgcgcctgtcagcaaaatacggaaaccaggcttaatgaagcccagccgctcaagatcgctcagcaagcccgtaccatcggtgttatcccccagcaaacggccatcctccagccgcttgagggtattcactgcccctgccagcgctgcgcgctctgtcagttcatcggcccgggcaaacgcctcttctttaaaggggaccgtgatgttagcccccttcccccccgccgcaaaaaacgcattcagggtattcacaaaatcatctgctggcgccagcacacgaccataagggtgatcaatttgcagctgctgcgcaaattgttgatgaataaacggagacttactgtgggcgatcgggttaccgaataccgcatagctttccatatattacccctgtcggaagcgctcgccggtcagcgcgtcacgtatttctgaagggttctgacgcccgccagtttcgccctccaccaccggaaaatgatcaccgaactgggcgcgtacttcttctgttgtacggcacggcggtaagcccgtcagattagcgctggtcgaaaccagcggtttgccgtaggcctcgcataaggccaccaccagcggatgattggtaacgcgtacagccagcgtatcaaaacggccggttaaccagcgcggcgtcgtgggtcgcgccgggaatacgaatgtcaccggacctggccagctggcaaagacggcctcacgctgcgattcattcagggcgctgtcgtcgatgtagggtttaagctgttcgaaattcgccgcgataaggatcaaccctttttccaccgggcgttgttttaactcaagcagacgctggactgcgatctcactatcaggatcgcagccgacaccaaaaacagcctctgtaggataagcgatgacttctttattattcagtaccgccaccgcgtcagcgatgcgatctgattgcaggttattcttcactgtttaattccgccggaaccggctttccacattgtttactggcgcaaaagcgtttaacgccctgcgcggttttcttttcgatgagtaacggatactggcagacaggacactcgccagctatcggtttaaaattgataacgaactgacagtcaggataaccatcgcaggagtagaaagttttgccgtaacgggaacgacgctgaaccagatgccccgtctgacactgcgggcaggtaatggcagtatcatcaggtttatcgatcagttcggtatgttcgcaagtgggatactgactacagccgataaacatgccgtagcgcccctgacgcagcaccagctcagcgccacatacaggacaaagctgcccctccagaactttaacgatatgaccgtcagcctggttttttagcggacgaacaaaatcgcattccggatacagggaacacccaaggaaaggtccgtgcttcccggaacgaataacaagctgagccccgcattgtggacagggctcctgattaggcaccgagaacagtgctgatttggccataacaactcttgctgctgcaacgatgatttagtgcagcataccttcattcacttcaaagagtaattcttccatctgctgataggcgttttcacatccggggatattaaacagtaccatcagaatgacccattttagatcttccagatcgaactctgcggtatccagcgccagcacgcgttcaatgaccatttcccgcgtttcgaggtttagcacctgaatctgctccaggaataacaagaatccccggcaactggcatccagcctctcacactcttctgcagtataaatacgaacagagagtgggtctgaagcgagctgcatcggttcggcgaggccttcctgataatcagccagcttttccagccacaataacgcgttgtagatgtcctcacgatcaaaaccagcgtctgtcagatctgactccagtttatcctgatccacgcgcaattcagcttcgttgtggatgtaagtctcaaacaaatacattagtacgtcgaacatggcttgccctccttaatcggacatagccgccgggtacaactgcgatccatcctgctaactccagttcgagtagctgagccacaatcactggcacaggttggccggcacgttcagcgacgacgtcaacaggtgttacctcatctcctacgttagccaggagctcaggaaatggcaatgccgcgttatccggttctgaagaattaattagcttatcgctgtgatctggcacccaatgtagcccatattgcaaactttccagaatctcctcaggcgatgtcaccagcattgccccctgcctgataagactatgcggtccttcacagccagggttgcccaatgggcctggcagagcaaaaacctcacgtccctgatccagcgcgcaacgtgccgtgaccagcgaaccgcttttcagcgccgcttccaccaccagcacgccgcggcttagtccactaataatgcggtttcgtcgcgggaagttccccggccagggcaccgcagataaagggaactctgaaaccagcgcgccgccagcattaaggatgccgtcggcaagcgcgcgatgccgctttggataaacgctgtgtaaaccgtttcccagtaccgccaccgttttacctttgccgttaagcgctgcgcgatgggcaatgctgtcgattcccagagccagaccactggtaatggtcacgccataacgcacaagctgttcacagaactgacggccccatcgctcgccataccatgagtgggcccgactaccgacgacacccagttgctgcgacttcagtacgccgatatccccttcgacaaagagcgcgccgggataatcgctgatggctcttagctgcggcgggtaagcggcatcagtggccagcaacagatggtggtcgggagccgtaagccacgccaggctgcgttcaatttcacccgcagccagcgcctgaaattttgcgatctgctgtggggtcagtccagcgtggcttaatgtcgaggtcgtgatatccgggttctgcaataaagattgcgcgacgttaagcatcttgtcgccatacagatcccctacgtaaatcaggcgcaaccaaatctctgtcagagtcatcctttccccttgccacaggcagcctcagcaatctttgcgattggtcactgatgctgtcaatcagagggggatttgtctagaataggaggaataatcttttctactcctgaacacaactctggaaatttatggcagttttgcacgtgttacatatcccggacgagcgtcttcgcaaagtcgctgaaccggtaaaagaagtgaatgcagacattcagcgtatcgttgatgatatgttcgataccatgtatgccgaagagggtattggcctcgccgcaacgcaggttgatattcatcagcgcattatcgttattgacgtctccgagaatcgcgatggtcgcctggtgttgatcaatccggaactgctggaaaaaagtggcgaaaccggtattgaggaaggctgcctgtcgatcccggagcaacgcgctctggtgccgcgtgcagagaaagtaaaaattcgcgcgctcgacagagacggtaagccgtttgagctggaagcggatggcctgctggcgatctgtattcagcatgaaatggatcacctggtcggtaagctgtttatcgattacctgtcgccgctgaagcaaaaacgtatacgtcagaaagttgagaaactcgaccgcctgaacgcacgggcttaaggataagaatcaacgtgtcagattcactacgtattatttttgcgggtacacctgactttgcagcgcgtcatcttgacgcgctgttgtcatccggacataacgtcgttggcgtatttacccaaccggatcgcccggccggacgcggcaaaaagctgatgccgagcccggtaaaagtgctggcggaagagaacggtttaccagtgtttcagccagcgtctttacgtccgcaggaaaatcagcacctggtcgccgacttacacgcagatgtgatggttgtagtggcctatggtctgattctgcccaaagctgtgctggatatgccccgtctgggctgcattaacgttcacggttcattgcttccccgctggcgcggagcggcgcctattcagcgcgcgctttgggcaggcgatgcggaaaccggcgtcacgatcatgcaaatggacgtcggcctggatacgggcgatatgctgcataagcttgtctgcccaatcacggccgaagataccagcgcgacgctgtacgataagcttgcagagttagggcctgccggcctgattgaaacccttgcacagctggcgggtggcacagcccaaccgcaggtacaggatgaagcgcaggtaacctatgcggagaaactcagcaaagaggaagctcgcatggactggtccctgcctgccgtgcaacttgagcgctgtatccgcgcattcaatccatggccgatgagctggcttgaaatcgacggccagccgctgaaaatctggaaagcgtcagttatccattctgagactaccgccgggccgggcacaattgtggacgccactaaacagggcatccaggtcgctacgggcgacggtattctgaatatagaatcgctgcaaccggccggtaaaaaagcaatgagcgcgcaagacctgctcaactcccgccgggaatggtttgttcccggacatcgtcttgcctgacgagcatcacgtctcaagcccggggttaccgggcatttttattttgtggctatgaaaaaaaatattaatttacgcagcatggcagcccaggctatcgaacaggtcgttgaaaaaggccagtccctcagcaatgtcctgccactgttacagcaaaaagtatccgataaagataaagccctgcttcaggagctgtgttttggcgttctgcgtaccctgtcgcagatggagtggctgatcaataaattgatgtcacgcccgatgaccggaaagcaacgcaccattcattatctgatcatggtagggttttaccagctcctgcatacccggatcccgccgcatgccgcgcttgcggaaaccgttgaaggggccgtggcgataaaaagaccacagctaaaaggcctgattaacggcgtgctgcgtcagttccagcgtcagcaggaaacgttgctggccgaattcgcttccagcgagagccgctttctccatccggagtggttgctgacccgcctgcgtaaagcgtatccgcggcagtgggaagccattgtcgaagcaaataaccagcgtccaccgatgtggctgcgcgtgaatcgcaatcaccactcacgcgatgcctggctggccttactggaagaaacagggcagcaaggttttacgcatccagactatccggatgcggtgcgtcttgagtcccctgcccctgttcatactctgccaggcttcgaagaaggctgggtgaccgtacaggatgcgtcggcccagggatgcatgacttttcttgagcctgaaaacggtgagcacattctcgatctgtgcgcggcgcctggcggcaaaacgacgcatattcttgaagtggcgcctgatgctcaggtgctggcggttgatgtcgatgaaaaacgcctgtcgcgcgtttacgacaacctgaaacgtctgggcatgaaagcgcaggtgaaacagggcgacgggcgtttcccggcccagtggtgcggtgagcagcagtttgatcgtatcctgctggatgcgccgtgctcggcgacaggggttatccgccgtcatcctgatattaagtggctgcgtcgcgatcgtgatattgccgaactcgctcagttacagtcggagatcctggatgccatctggccgcaccttaagcctggcggcacgctggtctacgcgacttgttccgtattgccggaagagaacagtcagcaaatcgccgcgttcctggcacgtacgcctgatgcaaaactcagcgttaccggcacgccggacaatcctggcaagcagaatctgccgggtctggaagacggcgatggcttctattacgctaagctaatcaaacagtgactgaaatgacgggccgcaactgatgaagattatcattctgggtgccggacaggttggcggcacgctggcagaaaacctggtcggtgagaacaacgatattactattgttgatattaacggtgacaggctgcataacctgcaggacaagtttgatctgcgcgtggtacagggtcatggctcacatccgcgtgttctgcgagaagcaggggccgatgatgccgatatgctcgtcgctgtgaccagctctgatgaaaccaacatggttgcctgccaggtcgcttattccctcttcaatacgcctaaccgcatcgcgcgtattcgttcacctgattatatccgcgatgcagataagctctttcacaccgaggcggttcctatcgatcacctgattgctcctgagcaactggtcatcgacagcattcaccgtctgatcgaatatccgggtgcgttgcaggtcgtgaattttgccgaaggcaaggtcagcctggcggtggtgaaagcttattatggcgggccgctggtcggcaatgcgttgtccaccatgcgcgaacacatgccgcatatcgatacgcgtgtcgcggcaatttttcgtcatgaccgtcctatcaggccgcagggatcaaccatcgttgaagcaggtgatgaggtcttctttatcgccgcttcgcagcatatacgcgcggtaatgagtgagcttcagcgtcttgaaaagccttacaaacgcatcatgctggttggtggtggcaatgtgggggcgggtctcgcgcgtcagctggaaaaagactacagcgtgaaactgatcgagcgcgatcaaaagcgcgccgctgagctggcggaaaagctgcaaaacaccatcgtcttctatggtgatgcgtcggatcaggagttgctggcggaagagcatatcgatcaggtggatctctttattgccgtcaccaacgatgatgaagcaaatatcatgtctgccatgctggcaaaacgcatgggggcgaaaaaagtgatggtattgatccagcgccgcgcctatgtggatctggtacagggtagtgtgatcgacattgcgatctcaccgcaggaagccactatctctgccctgctcagtcacgtccgtaaagccgatattgtcggcgtctcctcactacgtcgcggcgtggctgaagccattgaagccgtggcgcacggtgacgaaagtacatctcgcgtggtgggcagagtgatcgatgatattaaacttcctcccggtaccattattggcgcggtcgtgcgcggcaatgatgtcatgatcgctaatgacaatttacgcattgagcagggcgatcacgttattatgttcctgacagataagaagtttatttctgacgttgaaagactattccagcccagtcccttcttcctgtaatcttttaaaggcgctaaaaatagcgccttttttatttaatcccttcatttacaaaggattagtaatttaactcaattgtcctgcttacatggaaaataaagtgagctttgttagacttaggtgggtctgcggtgataaggagaataaaatgagcatgttaaaagagtttcgcgcgtttgcgatgcgcgggaatgtaatcgacctggcagtgggtgtcatcattggtgcggcattcggtaaaattgtctcttctctggtggctgacatcatcatgccacccctgggcctgttgattggcgggattgattttaaacagtttgcatttacgctacgtgaagcgcagggcgatattcctgcggtagtgatgcattacggcgtgtttattcagaatatttttgattttctgatcgtggcgttcgctattttcctggcgatcaaactgatcaatagacttcatcggaagaaagaggaagagccaaaagcaccgcctgcgccttccaaagaagaagtactgttaacggaaatccgtgatttactgaaagagcaaaacagccgtcccggtctttaacagacgacggaaacaagaaggccagtggcaaaaaagtgcttcactctcttgccactggcctcctgaccactccgttttgcatgtttcgcttttcgcagataactgcctttgcctttcttgtttttctcaatacgctgacgaaacagcggatcatggagtaatgcttccagggcgttatcgttaatctgccctttctggtgctgatagcgactcatattttctccggaatgttatataaaacgtggcgagtgtagatctgactttgctaaagatcaactgcctcagttttactgccacttccctgctccagggcttcaaggatcgaacaatagatgctgctatgggcagtaccgcagcaggcatcgtttagtcgctgcaaagagcgccgcatagtttgtaactcttctatccgctcttcaacttcgcttagcctggcttgtacgatactttttgattcctggcaggtgtggtgctcaggatcaacgcgtatcgacaaaagctcccgaatcgactccagggtgaatcccagttgccgggcatgacgtataaacttcagacgctgaagatcgttatcggtataaaggcgaaaaccgccctgggtgcgcacttcgtgatccatcatttgctgcttttcataataacggatggtatcaggggtcacctcagccagtctggccagttctccaatgcgatacataagagctcctcatgcagttatggcaaattttaagcatacccgcacagggtaacgaataaaatcataaaggcatttgtgaaggcattaaagggaggggtgattaagggggcgggacggaaataaaaaaacccgccgaagcgggtttttctatattactgcagattactctgcagcagcttctgctttcgattcagagcgatcaaccagctcgatgtatgccatcggcgcgttgtcgcctgcacggaagccacacttcataatgcgagtgtaaccaccggcgcggctcgcaaaacgcgggcccagctcgttaaacagttttgccacgatctcgttatcacgagtacgggcgaatgccagacgacgattagctacgctatcagtcttggcaagagtaatcagcggctcaactacgcgacgcagctctttcgctttaggcagggtcgtcttgatgatctcatgacgaaccagtgaacctgccatgttgcggaacatagcctggcgatggctgctgttgcggttcagttgacgaccactcttacgatggcgcatgaccttatccttctcagtaaaaccttaacctgtgatccggttactcgtcagcgatgcttgccggtggccagttttccaggcgcatgcccagagacaaaccacgggaagccagcacgtctttaatctcagtaagagattttttaccaaggttaggcgttttaagcagctcaacctcggtacgctgtaccagatcaccgatatagtggatagcttctgctttgaggcagttagcagagcggacagtcaattccagatcgtcaacagggcgcagcaggatcggatcgaattctggtttctcttctttcacttccggctgacgtacatcacgtaagtcaacgaaagcttccagttgttctgccaggatggttgccgcacgacgaatcgcctcttcaggatcgattgtgccgttggtttccatttcgatgaccagcttgtccaggtcggtacgctgttctacacgcgctgcttcaacattgtaggcaatacgctctacagggctgtaacatgcgtcgaccagcagacggccgattgggcgctcatcttcttccgaatgaattcgggcagaagccggcacataaccacgaccgcgctgaactttgatacgcatgctaatagacgcgttctcatcggtcaggtggcagatcacgtgctgcggcttgacgatttcgacatcaccatcatgggtaatgtcggctgcagtcacagggccaatgccagatttattcagggtaagaataacttcatctttaccttgaactctcaccgccagccctttcaggttgagcaggatttccaggatatcctcctgaacaccctctttggtgctgtactcatgaagtacaccatcaatctcaacttcggtcaccgcgcaacccggcatcgatgagagcagaatacggcgcagtgcgttacccagagtatggccaaagccacgctctaaaggctcaagggtcaccttggcgtgcgtcgaactcacttgctcgatatctaccaggcgcggttttagaaactctgtcacagaaccctgcattgtgtcctctctttggtactaagctttacttggagtaaagctcgacgatcaggtgttcgttaatgtccgcagacagatcagaacgctcaggcttacgcttaaacgtaccttccatcttgccaccatcaacttccagccaggttggcttttcacgctgctcagccagctccagagcggctttcacgcgagattgctttttcgctttctcacggatactaaccacatcattcgggctaacctgataagaagcgatgttaacaacacgaccgtttaccatgatagccttgtggctaaccagctgacgtgcttcagcacgagtggcgccgaagcccatacggtatacaacgttgtccagacgaccttccagcagagccaacaggttttcaccggtgttgcctttcagacgtgctgcttctttatagtagttacggaactgacgctcaagcacaccgtagatacggcgaactttttgcttttcacgcaactgtacaccatagtcagacagacgcggtttacgcgcaccgtgctggccaggagcttgttcaatcttacacttggtatcaatcgcgcgaacgccagacttcaggaacaggtctgtgccctcgcgacggctcagcttgagcttaggacccaaatatcttgccattttctttctccaacattcctaaaaacgagcgttatacgcgacgttttttcggcggacgacaaccgttgtgagggatcggagtcacatcagtaatattagtgatgcggaaaccagcggcgttcagagcacgaatggtagattcgcgacccggacccggtcccttgaccataacttccagattcttgataccgtattctttcacggcgtcagcgcaacgctcagctgcaacctgagctgcaaacggagtggatttgcgagaaccacggaaaccggaaccaccggctgttgcccaacccaaagcgttaccctgacgatcagtaatagtaacgattgtgttgttgaaagaagcatggacatgagccacgccgtcagagacttgttttcttacacgcttacgtgcacgaactggtgcctttgccattattcaatcaccccgattatttcttgatcggtttgcgcggacccttacgggtacgtgcgttggtcttagtacgctgaccgcgcacaggcagaccacgacgatgacgcaaaccgcggtagcaaccaagatccatcaggcgcttgatgctcatgctaacttcacggcgcagatcaccttcaacgacaaatttggcaacttcgtcacgcagcgtgtcgatttgttcttcagacagctcactgatcttaacatcttcagcgatacccgcagaagccagaatggctttagaacgggtcttgccgacaccgtagatcgaggttaacgcgatcacagcgtgtttttgatcaggaatgttaatgcctgctatacgggccactatgcactcctactatttaatatgtacgcaccatgctgaaaagcccgttttcaggatactcaaatggatacgcacagacatacaaaagattggctggctaatctagccagctcaacccaactttgcaagaaaaatatgcgaattaatcagccttggcgctgtttatgcttcggctcggcactgcaaatcacgcggatgacgccatcacgcttaacgattttgcagttacggcataatttcttgacggaagcacgaactttcatttttactctccgtaacttctcgagcgacctttagcggccatagcctttaaggttcgccttcttcaatgcagactcgtactgactggacatcatcagagtttgcacttgagccataaagtccataatcacaacaacaacgataagcagtgaggtcccaccaaagtagaacggtactttcattgcgtcacgcatgaactccgggatcaggcagataaaagtaatatagagcgcgccgaccagggtcagacgtgtcattactttatcgatatacttcgccgtttgctctcccggacgaattcctggtacaaatgcaccggacttcttcaggttatctgctgtttctcgcgggttgaaaaccaacgccgtatagaagaaacagaagaagatgattgcagacgcatagagtaacacataaagcggttgccctggctgcaaatacagcgaaattgttgtcagccagttccaaccggtaccgcccccgaaccatgacgcgatggtcgccgggaacagaataatgctggaagcgaagattgccgggataacccctgccatattcactttcaacggtaaatgtgtgctctgtgcagcatagacacgacgaccctgctgacgtttcgcgtagtttaccacaatgcggcgttgaccacgttcaacgaaaacaacaaagaacgtcactgcaaatactaatactgcaaccaacagcaacaggaggaagtgcaggtcgccttgacgcgcttgctcgatcgtatgggcaatggctggcgggagtcccgcaacgataccagcgaagataatgattgagataccgttaccgataccgcgttcagtgatctgttcgccgagccacatcaggaacatggttcctgtgaccagacttacaacagcagcgaaatagaatgcaaagcctggattgattaccagaccttgcataccaggcatattcggcagaccggtagcaataccgatcgactggaatatcgccaacaccagagtaccgtagcgggtgtactggctgatcttacgacgaccagactccccttctttcttcatttctgcgagggtcgggtgaacgaccgtcaacagctggataataatcgacgccgaaatatacggcatgatacccagagcaaagattgaagcacggctgagtgcaccaccagagaacatgttaaacatttcaatgatggtgcctcgctgttgttcaagcagtttggcaagtacagtggcatcaataccagggatcggaatgaaagagccaatgcggaacacaatcagcgcgccgattacaaacagcagtctgcgtttcagctcgcctaagccacctttggcactttgaaaatctaatcccggttgtttagccatctgctacttattcctcgattttaccgccagcagcttcgatagcagcacgagcgcccttagaaacacgcaggccacgaacagttaccggagttgaaacttcaccagccaggatcactttcgcgaactcgatctggataccgataatgtttgctgctttcagcgtattcaggtctacaacgccgccttctactttagccagatcggacagacgaacttctgccgtgatcatcgctttacgagaagtgaagccgaacttcggcagacgacggtacagaggcatctgaccaccctcgaaaccacgacgtacgccaccaccagaacgagagttctgacctttgtgaccacgaccgccggttttaccgaggccagaaccgataccacgaccaaggcgtttacccgccttcttagagccttcggccggagacagagtatttaaacgcatctcttactcctcaactttaaccatgaaggaaaccgcgttgaccataccacgaacagcgggagtatcctcgcgctcaacggtatgaccaatacgacgcagacccaggccaagcagcgttgccttgtgtttcggcagacgaccgattgcactgcgggtttgagtgattttaatagtctttgccatggtcaattaccccagaatttcttcaacggatttaccacgcttggcagcgaccatttctggagaattcatattttccaggccatcaatagttgcacgaaccacgttgatcgggttggtggaaccatatgctttagccagaacgttatgaactccagcgacttccagaacggcgcgcattgcaccaccggcaataataccggtaccttctgaagccggctgcatgaatacacgagaacccgtgtgaacacctttaaccgggtgctgcagggtgccgtggttcagcgcgacgttaatcatattgcgacgggctttttccatcgctttctggatcgctgctggaacttcacgcgctttaccgtaaccaaaaccaacgcgaccgttaccatcgccaacaacagtcagagctgtgaaggagaaaatacgaccacctttaacggttttagatacgcggttaaccgcgatcagcttttcctgcagttcgccagcctgtttttcgatgtgagccatcttacacctctaccttagaactgaaggccagcttcacgggcagcatctgccagtgcctggacacgaccatgatattggaacccggaacggtcaaaggaaacatctttgatgcctttttccagagcgcgttcggcaacagctttacccacagctgcagcagcgtctttgttaccggtgtacttcaattgttcagcgatagctttttctacagtagaagcagctaccagaacttcagaaccgttcggtgcaattacctgtgcgtaaatatgacgcggggtacgatgtaccaccaggcgagttgcacccagctcctggagcttgcggcgtgcgcgggtcgcacgacggatacgagcagatttcttatccatagtgttaccttacttcttcttagcctctttggtacgcacgacttcgtcggcgtaacgaacacccttgcctttataaggctcaggacgacggtaggcgcgcagatccgctgcaacctgaccgatcagctgtttatcagcgcctttcagcacgatttcagtctgagtcggacattctgcggtgatccccgctggcagctgatggtctacaggatgcgagaaacccagagacaggtttactgcattgcctttaaccgctgcgcgataacctacaccaaccagctgcagcttcttagtgaagccttcggtaacaccgataaccattgagttcagcagggcacgcgcggtaccagcctgagcccatccatccacgaaaccagcacgcggaccgaaggtcagagcattatctgcatgattcacttcaacagcatcgttgagagtacgagtcagctcgccgtttttacctttgatcgtaataacctgaccgttgatttttacatcaacgccggcaggaacaacgaccggtgctttagcaacacgagacattttttcctccgattaggctacgtagcagataatttcgccaccaagaccagcctggcgcgctgcacgatcagtcataacacctttagaggtagaaacaactgcgatacccatgccggccataaccttcggcagctcatcttttttcttatagatgcgcagacctgggcggctgacacgctgaatgctttctacaacagctttaccctggaaatacttaagagtcagttccagttccggcttggtgtcgccttcaactttaaattcttcaataaaaccttcttccttcagcacgttggcgattgccactttcagcttggaggaaggcatggtgaccgcaactttgttcgcggcctgaccgttacggatacgggtcagcatatccgcgatcggatcttgcatgctcatctgtctttactcccgtgattcaattggtgacaattaccagctagcctttttcagacccggaatttcaccgcgcatagcggcttcacggaccttaatacggctcaacccgaacttccgcaggaaagcgtgcggacgaccagtttgacggcagcggttacgctgacgagacgggctggaatcacgcggcagagtctgcagcttcagaactgcattccaacgatcttcgtcggttgcgttcacatcagagatgatagctttcagttcagcgcgtttagcgaagaatttatcagctaaagctacgcgttttacttcgcgtgctttcattgattgcttagccattcagtaaccctaccttacttgcggaacgggaagtcaaaggcagccagcagagcacggccttcttcatcagatttcgcagtagtggtaatggtaatatccaaaccacggacgcgatcgactttgtcgtaatcgatttctgggaagatgatctgctcacggacacccatgctgtagttaccacgaccgtcgaaagacttagcggacaagccacggaagtcacggatacgcggtacagcaatagtgatcaggcgctcaaagaactcccacatgcgttcgccacgcagagttactttacagccgatcggatagccctgacggattttgaagcctgcaacagatttgcgtgctttggtgataaacggtttttgaccggagattgctgccaggtcagctgctgcgttatccagcagtttcttgtcagcgatcgcttcaccaacacccatgttcagggtgatcttctcgacccgagggacttgcatgacagaattgtagctaaactcagtcatgagttttttaactacttcgtctttgtagtaatcatgcagtttcgccatcgtactactccaaattacttgatagtttcgctgttagacttgaagaaacggacttttttgccgtcttcgaatctaaagcctacacggtcagccttgccggttgccgcattgaagatagcaaggttagagatctgaatagctgcttctttctctacgatgccgcctggttggttcagagccggaaccggcttctggtgtttcttaaccaggttgataccttcaacgatgaccttgccggaagacaggacattttttactttaccgcgcttacctttatctttaccggttaacacgataacttcgtcatcacgacggattttagctgccatgattcgctccttagagtacttctggtgccagagagataattttcatgaacttttcagtacgaagttcacgagttaccggcccaaaaatacgcgtaccgataggctgctcactgttattgtttaaaataacgcatgcattaccatcgaagcgaatgacagaaccgtccgggcgacgaacacccttcctggtgcgcaccactaccgccttcagcacatcaccttttttgaccttaccacgcggaattgcttctttgatggtgatcttgatgatgtcgcctacgcctgcgtagcgacggtgcgagccacccagaaccttgatacacattacgcgacgtgcaccggagttgtcggcgacggtcagcatagtctgttcttggatcatttcagtgctccgctaatgtcaactactactttgggacccaaatctcgggtcgttaaaaagccccatatcgggggcgcggcattataacaccgcttcttagatatgggtagaaaaaataaacggcccatttctggaccgtttatcgttgagaacgcgtactgtattacagaatcgctttctctacaacgcgaaccagcgtccaggacttagtcttggacagcggacggcattcgcggatttcaaccacgtcaccagtaccgcattcgttgttctcgtcatgtacgtgcagtttggtcgtacgcttgatgaatttaccgtagatcgggtgtttcacaaaacgttcgatagcaacaacgatggatttctccattttatcgctaacaacgcgaccttgcagagtacggattttatcggtcattacgcacccgccttctcagtcagtaaagtcttaacgcgtgcgacatcacgacgcacttgcttcaacaggtgagactgttgcagctggccactggctgcctgcatacgcaggttgaactgctcacgcagcaggttcagcagctcggtgttcagctcttcaacactcttctcacgcagctcttttgctttcattacatcaccgtcttagttacaaaggtggttttaatcggcagtttcgctgctgccagcttgaatgcttcacgggccagctcttcagacacaccgtccatttcgtacaggactttacctggctgaatcaaggcaacccaatactccacgttacctttacctttacccatacgcacttcgagcggcttttcggtgatcggtttgtccgggaatacacggatccagatcttaccttgacgcttaactgcacgggtcatagcacgacgtgctgcttcgatctgacgtgcagtcagacgaccacggccaacagctttcagaccgaaagtgccgaagctaacatccgtaccctgcgccagaccacggttgcggcctttgtgcactttacggaattttgtacgctttggttgtaacatcagcgacgctccttatttccggcctttacgctgctgctttttaggttgagcagccggtttttccggttgttcaacagcagccataccacccaggatctcacctttgaagatccacactttaacgccgattacaccataagtggtgtgcgcttcagaggtgttgtagtcgatgtcagcacgcagagtgtgcagcggaacgcgaccttcacggtaccattcggtacgtgcgatttccgcgccgcccagacggccgctaacttcaactttgatacctttagcgcccagacgcattgcgttctgtacagcacgcttcatagcacgacggaacataacgcgacgttccagctgtgaagtgatgctgtcagcaaccaatttagcgtccagttccggtttacggacttcggcgatattgatctgtgcaggaacgccagcgatatccgctacgaccttacgcagtttttcgacgtcttcgcctttcttaccgataacgatacccgggcgagcagtgtgaatagtcacacggatgctcttagccggacgctcgataacgatacgagatacggacgccttcgccagttccttagtaaggtactgacgaactttaaaatcgctgtccaggttgtcagcgaattctttggtgttcgcaaaccaggtagagttccatggttttacaatacccaggcgaataccattaggatgtactttctgacccattgctagtctccagagtctcagcgatcggacacaaccacagtaatgtggctggtgcgcttcaggatgcgatctgcacgacctttcgcacgcggcataatgcgcttcatgcttgggccttcgtctacgaaaattttcgcaactttcagatcgtcaatgtcagcgccatcgttgtgttcagcgttagcaatggcagattccagaaccttcttgaccagtacagccgctttcttgttggtgtaggtcaaaatgtccagggcctgcgacactttcttaccgcggatcaggtctgccaccaggcgaaccttttgagcagaagaacgagcgtggcgatgttgagctaaagtttccatctcttcctcctacttatttcttcttggcttttttatcagccgcgtgaccgcgataagtacgtgtcggtgcaaattcacccagtttgtgaccgaccatttcgtcggaaacaaataccggaacgtgctgacgaccattatggacagcgatggtcaaaccgatcatgtttggaaagatcgttgaacgacgggaccaagtgcgcaggggcttcttgtcaccgctttccaccgctttctctaccttcttcagcaagtgcaggtcaataaaaggacctttcttgagagaacgtggcatggcttatcctctaatattatttgctacggcgacgtacgataaatttatcagtacgcttgttgctgcgggtcttcttacctttggtctgaacgccccacggagttaccgggtgcttaccaaagttacgaccttcaccaccaccatgtgggtgatctaccgggttcatcgccgtaccgcgaacggtaggacgaacaccacgccagcgtgcagcacctgctttacccagaacgcgcagcatatgctcagcattgccaacttcgcccagagttgcgcggcagtcagcttcaactttgcgcatttcgccagaacgcagacgcagggtgacataagcaccatcacgagcaacgatctgaacataggtaccagcagaacgcgccagctgaccgcctttacctggtttcatttctacgttatgaacggtagaaccaaccgggatattgcgcatcggcagggtgttacccgctttgatagcagcatcaacgccagactgaatctggtcgccagctttcaggcctttaggggccaggatgtaacggcgttcgccgtctttgtacagaaccagcgcgatgttcgcggagcggttcggatcgtactcaagacgttcaacaacagccgggataccgtctttgttgcgtttgaagtcaacaatacgataagcctgcttatggccgccaccgatgtgacgagtggtgatgcgaccattgttgttacgaccaccggatttgctgtttttttcaaccagcggagcaaaaggtttgcccttatgcagctcagggttaaccactttaacaacgtggcgacgacccggagatgtcggtttacacttaacaactgccattgtattactcctccgacttactcagcgccgccaacgaagtccaggttctggccttctttcagggtgacgtaagcttttttccagtcgctacgacgaccgatacgctgtccgtgacgtttaactttccctttaactaccagggtgttaacgacttcgacttcgacttcaaacagtttctgcacagcagctttgatttctgctttggtcgcgtctttaccaactttgagaacgatggtattggttttttccatcgcagtagacgctttttcagaaacgtgcggcgcacgaagcaccttcagcagacgttcttcacgaatcatgccagcatctcctcaacttgcttaacagcatcagcagtcattacgactttgtcgaaggcgatcaggctaaccgggtcgatacctgctgcgtcacgtacgtcaaccttgtgcaggttacgtgcggccaggaacaggttctcgtccagctcaccggtgatgatcagcacatcttccagagccatgtctttcagtttctgagccagcagcttagttttaggcgcttctacagagaactgctcgacaacgatcagacgatcctgacgtaccagttcggacagaatgcttttcagcgcgccgcggtacatctttttgttaactttttgactgtggtcctgcggacgcgcagcgaaggttacgccaccggaacgccagatcgggctcttaacagaaccagaacgcgcacggccagtacctttctgacgccacggttttttaccagaaccggttacttcagcacgggtcttctgagcacgagtaccctgacgagccccagctgcgtaagcaactacaacctggtgtaccagcgcttcgttgaaatcacgaccgaaggtagtttcggaaacagtcagcgcgctctgcgcgtctttcaatactaattccattgctatctcctcacgccttcacagctggtttaacgatcaggtcgctaccggttgcacccgggacagcacctttaaccagcagcaggttgcgctcagcgtcaacgcgtactacgtccaggctctgaacagttacacgttcgttacccagctgacctgccattttcttgcctttgaacactttgcccggagtctggttctgaccgatagaacccggaacgcggtgagacaaggagttaccgtgggtagcgtcctgggtacggaagttccagcgcttaacggtaccagcaaaacctttacctttagaggtaccggttacgtcaacttttttaacttcagcaaacagctcaacgctaatgtcctggcctacagagaattcttcaccgtcagcaagacggaattcccacagaccacggccagcttctacgccagctttagcgaagtgacccgcttcaggcttggtgacgcggttagcttttttagcaccggtggttacctgaacagcacggtagccgtcgttagccaggtctttaacctgagtcacgcggtttgcttctacttcgattacggttactgggatagagacgccatcttcagtgaagatgcgggtcatacccacttttttaccgactaaaccaatcattgtatcaacctctcaatcgctcgatgacctgattaacccaggctgatctgcacgtctacaccggcagccaggtccagacgcatcagagcatcaacggttttctcggttggctcaacgatgtcaaccagacgcttgtgagtgcgaatttcgtactgatcgcgcgcatctttgttaacgtgcggagagatcagaacggtaaagcgctctttgcgggtcggcagcgggatcggaccacggacctgcgcaccagtgcgcttggcagtctcgacgatttccgcggttgattgatcgatcagacgatgatcaaacgctttaagacggatacggattctttggttctgcatgagaccagagctccaattattttatagacaaatagctactcctcatacccattacgattgatgggagagtgtaaccgttcttacagagttccccgattgggaacattgtttggtagccaaaagcgctgccagggttcatattgaaccagccgtcaattacgacaagccggcgtattatacttatacatggcccggatgcaaggtcttacgcttcaaaattgcacgatattcgcggccccgtcactgttcttcaccctgcacctctttcagcgcttgccggacgcgcagccgcaatgcgtcatggtcgcttgcggtgtcctcgcgctcgtcgtccaaagccgcatcctcatcgctggacagcagttcatcggccattatcccctcttcttctgcttcatcggtttcaatctcaatgcgggcaggcaacggtttctttttaaacacataatgcacatcggaaagccagtagttacgggctggttcatatgcagcgcggtctgagatctcaggtaagaaccgctgcccgatgacgtgcccgtaatagccgcacgccagcatcaggatgatccatagtgcccagccccctgcccgcagaccatggcgcctgcgctcgtctggtgttgctttcagcgtgacggcgcctttgtccccattttgcgcctggtaagccctgaagatccgcatcatttcgcgctttcctttattgctactgtatctgacgtactttcattaataagctgcggcgcctcgcccagcgcttgctgtaaacggatcagcgtgcgttttcccggtttgccatcctgcctgagattttcccgttgctggaagagcttcactttctcggtgagcgctggcgtccattcaccttgcttgtcgaccggcacgttgagcgcccggctgagtaacgcatccagccagacgatactttccggcgagcttttatcggaaaccgtgatttttccgtccggcgtctgcttttccatcagcacatagtttccgtcccagtgcgctgtaaaccagtcgcgccgcactgtccacgtcttaccggcaatcagcagatcaagttcagtgtccgacatgcgcatcaccaccgcatgtaatcctttatttatgcgtaactgcgccatccacggcagctcacgcccggccagatcgttcaggctcgctttgccactttcgcaggcaagttctgcgcgtccggcctgatcgcaccaggcctcttcagggaggacgtcatagccccaggtgctgaacagctgttgcatggcgtcgcgcatgtgggttccgctatcggtgatatcaacgaccggctctttttcttctgtggggatcatcatccagcccggaacaggaagcgccggttttagcgtatcgacactcagccagccaacggtgaatgccagcccggcgtatagcgccagcaggctgccacagcgtgccgcgctgcgttgcggcgccagcagattcagtaattgcccttcctgtcgcgctgtcagcgtggtcatctggcctgcaagcgccagctgatatgccgatctggctatacggctgagcagtgcaaggttgcctcgcgccgcgtttgctgcccgatcggtaaacgcccggcgcagacttaccacttccccctcattcatctggtgaagcataaatgcatgggtttcgtcactgtcgggcagaggcatgccgatcggaaaatcgatttgtgatttgattttccggtgacgcattaacgccttgctgcctgccaacagcaggctgacgcctgcctgccgggacgctgccagctgacggaaatcatgtatcagcaccggcaggtgacggctcagcacatccgcattatcaataatgaacagtacaggttggtcggcctccggcaccgctgacatcgcgtgctgccagaactgcgttatcgcaacaggctctgcattaacgggcgcggcgggcatcatccggcaacggtacgcttcgccaccagcccgccagacgcaggcgtgtccggggtaacccgccgcgagttggtgcgccagcgtcgattttccacatccgggcgcaccatacaacaggcccacactgccagaccgcagctcctgaacaataaaggttttaattaattcatatcctgaaaaaggatataacgtcgatagacgttctgtactgctcatttataaaaggtcatccatcagagccgttaatattatcaccacagaatataagaagaatcgtacagttatttcactacaatcatcattaaatatgatgaggttgaatacgatatttaaagactataccatattcagcttcttcaggataagtacgcagactcatggatacaagaattcagcaactggctggcgctattaaacaacaaagacagaccgtattatgcggactgctggtttgcttatccgcgatacttattatttattccgtgtatgattacgcgcaattgtcccgtaaatttactccgcaagatgagcccgcaggcgtttcgcggcgcatggccgcattcagcctgccaatgaacatgccgcagaataccgaggccttgccgaaaaatagtgataaccccagacaacaccaaagcacgccgctcaatctcattgttaatggtgtcatcgccagcaccttaagaaatcgctcccaggccattattacggtgaataacaaaacagaaatatataattttggtgattatatagaagatcttcccggcgtctttatttcctcgatcgacagcaacagcgtaaccattaataataacggtgagccacaaaattttattttgaatgattcacccgaattatcattatcgacatcgttatcgtcagcggcttcggaaactggcacggtttatctcggcgatctcctgattaccaatctggtttatcagcaggacgctttacagggcatcaggttgaatatgcgtaccgacgccgccggatcccttacggcgggactcaagcccggggatctggcgattaagatgaacagctacagcctgacgcgcaaagattccgcagaagcggccattcaggcgctggcctcattacgcaccgcgcaattcaccgtgctgcgcgatggacaggaagaactggtcaacgtgtcaacggacgcggatgacaataataaggataactaaattgctcaagggaatgacacgaactgccgcatggatgctggccttacaactttgttgcagtgccccttcatcggtggcggcgcagtactctgcaaacttcaaaaatgccgacatcagggattttatctcttcagtcagtaagcaaatcggcaaaaccattctggtcgatccctccgtccagggaagtatctcggtccgcagctttgataacttcaatgaggcggagtattaccagttcttcctcagcgtactggatatctacggttataccgtggttacgctggataacggcttgctgaaggtggtgcgttccgctgcgcttaaaaccgcgcccggcgtactgcaggagtcctcgcagccagcagtgggcgatgagtttatcacccgcgtggtatcgttaaaaaacgtgcctgcgcgcgatcttgctccgctattacgccagatgatggagggcggcggcatcggtaacgtggtgcattacgatccctcgaacgtgctgctggtgaccggcaaagccactatggttaaccgcattcttgaagtggtgaagcgggtggatgtgattggcacacaggagcgggaactggtgaagctgcgttacgcctcggcggtcgatctctcggaagtgatcaacaacctgctacgcgaagaatcaaaagaaaacccgacgcagatcctgttgccgaaagtcgtcgccgacaaacgtaccaacgccctgctcatcagcgggccagacaacgtgcgccagcgtctgaaatccctggtctacaagctggatattgagcagaccaacctcggcaacactcgcgttttctatctgcagtatgcaaaagccagcaaaattgtcgaggtgctgaccggcgtctcggcaaagctgtctgaagacaaacagtcctcgccgcagagcgtgtcatcgggccccagcgatgtctccattactgccgatgaacagaccaactcaatcgttattaccgccgatcaaagcaccctccaggagctggaaaaggtgatcgcgcggctggacattcgccgcgcgcaggtgctggttgaggcgatcatcgttgaagtacaggatggcaaagggctgaacctgggcgtgcagtgggcgaataacaatgttggcggtcaacaatttacccagaccgggctgccaatttttgatgcttcccagggcgcgcgccagtttaaagaaagcggttccatgagcagcgataacgctatctccagcgcgctgagcagttttaacgggctggcgacgggctttttcgagggcgactggagcgtgctgctcaccgcgctggcgtctgataacaagaacgatattctcgccactcccagtatcgtcaccctcgataacaaagaagcgtcctttaacgtaggccaggatgtccctgttctttccggctcgcaaaccacctccggcgataacgtctttaacaccgttgagcgtaaaactgtcggtactaaactgaaagtgacaccgcaggtcaacgaaggcgacgccgtcctgatggagatcgagcaggaggtgtccagcgttgacagctcatccggtaacgccagctccctcggccccacgttcaatacccgcaccatacaaaacgccgtgctggtgaaaagcggtgaaaccgtggtgctgggtgggctgctggatgagtccgccaaagagcaggtctccaaggtgccgctgctgggggacattccgcttataggccagctgttccgctatacctccaccgacagcgccaaacgcaatctgatggtctttatccgcccgaccattattcgcgatgatgaggtgtaccgttcgctgtcgaaagacaaatacacccgctaccgcgatatgcaaaagcagcgtatcgataagtccaccagcgcgttgatcaaagtcgatgatgacgagcgcccgatgctgaaagagatggatgaggatctggcgcccgcgcccggcccgtcagcacgcaatcctttcagggaatagggggttcgcaacatggctgatttatggaaacgcatcccgccaggacaaccgctgccggtgagctatgcgcaggtgcaaaaacagggcgtggcagtggccggcgatcaactggtctgccgtaccgatacgccgctggaaatcttactggaagcccgctacgccctgcccgaccgtgtccgattcacgcgtctggagcctgcacagtttgaggactatctggagccgctgttccgcaacggcaccggggactcgcggcagattgccgaagatctcgatcaggatgtcgatctggcgacgctgagcgaagagctgccggataatgcggacttgcttagcgatgaaaatgacgcgccggtgatccgcctgatcaacgccattcttcacgaggcggtaaaagaaggcgcgtcggatattcatatcgaaaccttcgagaaatcgctggtggtgcgctttcgcgttgacggcatcctgaagccggtgttgcagccgggcaaaaaactcgcgccgctgctgatttcacgtattaaagtgatggcgcgtctggatattgcggaaaaacgcctgccgcaggacggccgcatctccctgcgcctcgggcgtaaaaatatcgatgtgcgtgtctcgacgctgccctcgcagtacggcgagcgcgccgtgctgcgcctgctggataaaaacaatttacggctgtcgctggacacgatggggctgaccgccggcgatgcgcagcgcctgcattttctggtgcggcagccgcacggcatcatcctggtgaccggcccgaccggttcgggtaaaagcaccacgctgtacgcggtgctttctgagctgaactccccccagcgcaatatcctgaccgtggaagatcctattgaatacgagctggaaggcatcggccagacgcaggtgaacagccgcgtggacatgtcttttgcccgcggcttacgcgccattctgcgtcaggatccggacgtggtgatggtgggtgagatccgcgatatggaaaccgcgcagattgcggtgcaggcctccctgaccggccacctggtcttatcgacgctgcacactaacagcgcctgcggggcgatcacgcgcctgcgcgatatgggcgtggagccgtttctgctgtcgtcctccctctccggcgtgattgcccagcgtctggtgcgccggttgtgcccttcctgtcgcacgcaaaccgccctgcccggggagctaaaagccctgttgcgtaccctcgccccggatgccacccattgctggcaggcggtgggctgtagcgactgtcggggttcaggttaccaggggcgactggcgatccacgagatcatggtagtggataagcatatgcgcagcattattcatcgtgatgccgacgaacatgcgctggagcagtgcctgcgccagcaaagccgcagcctgcgggaaaacggtctgctgcgcgcccttgccggtgaaacgaccattgaagaagtcatgcgcgtcacctcagcgcaggaagaactgcaatgaaatttcagtggcaggcaatggatgccagcggcgtgacccgccatggaactttaagcgcggccagcagtaaagaggcccgtgacacgctgcgcgctcaggggctttacccgttgacgctgcgggaaaaaaagtcggtgtcatggtttacccccccgacaaaaaccgcgcggctgcggctgagcggcaacgaactggcgctttttacccgccagctggccaccctcgccagcgcctccctgccgctggaggaagcgctggccgttattggccgtcagaaccagaacagcaagctcaaccatatcctgaccgatctgcgcgagcatattctcgccgggcacacgctttccgatgcgctggccgcctggccgcgtattttcgacaccatttaccgcacgctggtcaaagccggcgaaaaaagcggccagctcggcacggtgctggaaaaactcgcggactataacgagctgcggcaaaaaatgcgcagtaagctcatccaggcgctggtgtatcccaccatgctgaccagcgtcgcggtgatcgtggtgaccattttgctgaccacggtggtacctaaagtcgtggagcagtttctgcatatgaaacagcagttaccgctgtccacgcgcgcactccttacgatcagcgatgcgcttcgcgattttggcccctttttgctggcggcgctggtggtcgcgctgctgttattccgccactggcttaccagacccggcaaacgtcatcagttcgaccgctggctgctggctttccggctcagccgggggctactgcgcgccgtgcactgcgcccgttatctgtacaccttaagcattttgcataccagcggcgtgccgctgctggaaggtatgagtctgtcggcagagggcattaacaatcgtgagatccaggcccgactgcgcgacgccgccgaccgtgtgcgtcagggatcgggttttcacctggcgctggataaatgcgatctctttccgccgatgatgctctatatgatcgcctccggcgagaagagtggccagctcagcgagctgatggcccgcgccgccgaacagcaggaaaccttattgcaaaaccgcatcgcgctggcgctggcactgtttgagccagggctgattatcaccatggcgatgattgtactgttcattatcgtctcggtgttgcaaccaatcttacaactcaattcattagtgacttaaggaaaagcaatatgaacacagagtctcagaaacggcagcaggggtttaccctgctcgaactgatggtagttatcgttattcttggcgtgctggcaagcctggtggtgcctaacttaatgggtaataaagagcgcgccgataagcagaaagccatcagcgacattgtggcgctggaaaacgcgctggatatgtacaagctcgacaaccatcgctacccggtaacggctcaggggctgaaagcgctggttgaaaagcccaccagctcgccgatcccggaaaattacaacacctccggctatatcaaacgcctgccgcaggatccctggggaaatgattatctgctggtcagccctggcgagcacggggattacgacattatctctgcgggcgttgacggtgaagcgggcacccaggatgacattaataactgggaaatggataaagcgaagccctgaccatgaaggcggtaaaaggatttaccctgctggaaatattactggtgctgacgctgctggcgttaagcgccacgctggtgatgatggtgagcgacgacgatcgcaaaaaagccatcaccgccggtgagcaactggcggcgctgatggaatacaccgctgactggtcaaccatggaagaccgcagcgcgggtattgagatccgtgaacggggctggcgcattgtgacgccagtacgtaaccgctggcagccccctgaaaactatttccggctggcgaccgaaggcgactggcacgacagctggcgggtcacgctctcgcccgcctctctggccagacaggccgccgggacgccgcaaatccttatccgtccggacggcgaaatcacgccctttacgctgcaaatccaggatcggcaaagccaggcagtactctttactctgaccagcaccggcggcctgccgttgcaattcagcagtggagcaacaccatgagccgccagcagtccggcatgaccctgctggaagtgctgttggcgctggtgatcttcgcctccgtctcgctgacgctgatcaacagcctgagcgggcaaatcgccgccacctccaagatggaagagcaggtgttcgccagttgggttgccgataatgtgctgaaaaagcagcagctatccgccacaccgctggccgcaaccgcgcagggtaaaagccagatgggccaacgaagctggacatggacgctaacggcgtcggcatcggacgtgccgggtatgcagctattaacggcggaagtttctattgataacgggcagaaaatgcggctccgccgctatgtgcccgcagagaaaggagccgccgatgccccgacacgctaaagcacagaccggcttcacgctgctggaagtgctgctggcgattgcgctctttgcggtgctcagcctgctcaccggccagttactgagggcaacggtaaacagcaatgaggtgacgaaacagcatcagcaacgttttgcgaccctggttcgcgcggtcaatctgctggataaagatgtctggcagatcgtgccgctgatgccgccggagggcgaaaaaagccgtctgatgctcaccaccgccagcaacaatgacatgccggacatctgctgcgcgccggatctgcagcgcgtagagtggtcgcttaaaaatcactccctttaccgcgccatctggcgctatccggaggatgagcagccgtccatcacgcagcccatgttgacggacgtgaacgcctttaccctgcgttattaccttaaggatgccgtggtgaccacgcttccgcccggggaatacccgagggcgattgaagccgaaatcaatatcaacgggtcaggcacgatcacgcgcctgcttctgctgccggaaaaccgccgcaacggaggcacgccatgagatcgcaaaaaggcgtggcgctgctggtggtgttgatgatcctggcaatcatggccgcgctggccagtgaaatgacgctgcgctatcagatcaatatcaagcgcaccggttatacgcggcaacagttgcagcagaactggctgctaggactggctgagcatcaggcgatgctgacgcttgcgcaggatctgcgcgataacgccaaactgctgacgcgcgatcagctgtgggcgcagccacagcggctgtcgcttgccagcggcgagaccatcaactggcaactgactgaccgccaggcctgctttaacatcaatgcgctggtgaatgcgcccactgacatcatggcggacgtgcccgccagcgtacaggtctttaccgccctgctcgccaatcttggcgtgaccggcgcaccagccgaagcgcttatcgacgccattgctgattatatcgacagcgatgaaacgccgcgccgtgccggtgcggaaaacgactattaccgcaccagtggcgatccccataccatcggcggacgccgcctgtattcggtaagcgaactccgtcagatcaaaggtatgacgcctgcgctgtaccagcagctcatcccttttacgtgtgcgctgccgaacgatgagctgaagatcaacatcagcactctgacgcgtaaagatgcgcctctgctggcggcgatgctgaataacgccgtgcaggtcagcgacattcgcgccctgtttgataaacagaagcgtcagggctggacgagcattgccgcgctgaaagcatccatcgaaaaatcctttccgggacgcaaggaagaactggaggcgtttaaaaatatcgctgccaccaccagccagtatttccggctggaaaccatcgtggatcagggggagagccgcagcggcacgatcagcgatctggaatttgatacgaaaaagtcgcaactctttatcaccgcccgccgacgcgcggcggtcgggcattaaaaggatttacctcgtgcagaaaattatcttacgccctttaccaggaaaactggtgtggtgcattgccggtgaaacacccgcgccgacgcttcacgaactggaggactatcttcagccgggcgcgctggcgcatctgccgcccgccgataccgtctgcctgttgctgtcgccggaatacctctgttttcgccgcgccgaacttcctgctgcaaattacaaaattacgccgcaaaccctgagctggctggtggaagacagcgtaaccggcaacgccgacgatctgctgtggacggtactctgccgggaagagaatacgctgcatctggcggggatcgcccggcgcgccctcgcggagatgctggcggcgttctcggtggcgggcgtgacgctcacccatatggtgccggatggtttctggctgcctcatgtggcgaacggctggagtctgagtcaggaggcgtcgcggtggatgatccgttacgacgcctggaaaacgggcgtgctggacgaggcgctgctaggtcatttgctcagctcctgcccggagatgcctgtcgtgagcgccagcccatttccggtggagcacaccgcggttgaatatattcaggagcccggacactggtacgacgctgacaccctgcctgcggttaacctcattcagggcgcgtttcgcccggcccggcctgtgagacaggcgccacgcgcgctgaaatatggcgcagcggtaatgacaggcctggcaatggcgctctttttcggtctgaaagggctgacgctctggcagttgcatcagcaaaaacaggcgctggtatccgaaggacggacgctgtggagccgctattttcccggcgaggatcgcagtaataacttcaaatttttcttcgcctcctccgttaaaaaccgtcatccggacgtgctgacgttgctgacgcagcttcaggaaaagttacagccctggccggggctgacgctaagccatgtcagttacgatctcgatactcaccgttttgaggcgatcctcaacgcgaacgatgccggacagctcagcggatttatggcccaggccgccggtgaatataccgttctgcaacaaccggacggtgtgaagatcagcttaaaggagcgcaaatgaattctttctggcaatcaagaagcgctggcgaaaaacgcagcctgatgctgctcgcgctgttcagcctgctgctggcgttctggtacggcgtactacagccgctgaacaaagccatcctgcaacaacagcaggaatacgcccggctgaaaagcgagatccagtgggtgagcgaggccgcacagcgcagcggactggtgggcagccagctgctgaccggtgacgtcccgacgctgatacagcacagcgcggcgcaggcgggtctgaacgtggtggtgacgccagccacgcccggtcgttttaccgtcgcgctttccgctgccagcagcagcgcatttttcagctggctggatgagatgcaaaaccggggtttgcaggtatctcgattagcgttcagcgcaggcagcgcgccggacagcatcaccattgcaacactcgaattcgctcaggcaggcacgcatgattaacgaaacgtacgtcgcaatgctggcgctggtagggttacttaccggcagcgttatgaatgtggtggtttaccgtctgccgctgatgatggagaacgactgcccggcaaactggcatatcgcctggccgccctcgcactgcccgcattgtcagcaccgcataaggtacgtggataacattccgctgctcggctggctgttgctgcatggccgctgccgggactgccggcagcccatctccgctcgctatcctctgaccgaactgacctgcggcgtcgctttcgcgctgattgccgcgctgttcccggaccatgccgatgcctttgccgtgatgctgctgttctggtttgtactggcgctggcgcaaatcgatgcccgcacgtacttgctgccggaccggctgacgcagccgttgatctggctcggtatgctttatcatgcgctgtatcagcagaacaccttaacggatgggctgttcggcgcggtggcaggctacctttcgctgtggctggtgtggtggatataccggctgataaccggtaaagaagggctgggacttggggatgcgaaattgctgggggcgctgggagcctggagtggctggcaggcgttaccgacggtgctgctgggcgcgtcactgatggggattgtctgctggatggcgctgcgcctgacgcggggtacgcaggttccacaaatcgccttcggtccctggctggggctggcgggatgggttattttcagcgcacagttgttggggtgggaaatatactgaagcagagcggcgaactgtcgccgctctgtggataatgcttactcttcgcggatctgggcctgcaggtaattctgaatgcccattttctggatgagatccagttccgtttccagccagtcgatatgcccttcttcatcggccagaatttcaatcatcatgtcacggctgacatagtcatgaacgctgtccgcccaggcaatggcttcgcgcagatccttcgccccatctaattcaagcgcaagatcggaacgcagcatctcttcaacatcttcaccaatgttgagtttgcccaggtcctggagattggggatcccttcaaggaacaaaatacgctcaatatatttatcggcgtgtttcatttcatcaatggattcatggtattcgacgtcattaagacgtttgaggccccagtttttaaacatgcgtgcatgtaagaaatactggttgattgcgacaagctcgtttcccaataatttattgagataatttattatcttaacatcacctttcattttatcgttcctccgcttccactacctacaagcgtagtagaacgtcgaaaaattgcgctatgcaaacggctgagcctgcggttaagcaggctctggttgttaagacttatactcttatttttgcagcatctgaggtgtgaccgtcatgcttgtcagcaccttcaggcgggcagaatcgggttgagagccatctgcaagcgcaaagacatattcatcgcccgcttttggattctcactggtagcgcttaagtatcgattattgcgcaagtcccctagcatggccgccgaggtccccgtattgacttgatccattttgtaaaacgatcctacgaaagtcgatcccgtcaccttaccagtttgatctttatgatcgatatacatgttgagatattgccgactatggacgaggcttatgtcagcgatcacactatattccagtttgccgttgatatttttaatgtaggtatcaacgatatcgctgctctccgctgtattcagttgttcctgagtcacctccagagaggcgtaaacattgctcgggtcattatcatcaacgagttttgccactactcctggctcagtgaatacccctgtattcaggcagaaaacaaccgtatcgctatcgggtttattctcactctcacagtaattcttactccctttcacgttaatgatagcgacatagttactgtgatcggtcggggtcggcatcgtgaatcgcagttttttattttcataaaaatcgcggctcattgtccatttgaaccctgcatctgcactgtttggaataacccggcccaactgaaaatgagtaatgttcggagcgacgtcctccttaatgacatcggcgacaatgttgcccagctcgtgcgtttcagtatcgccgctcagatcccagacgatagcgccaccaaattgctgctgcttaatgtaattaactttctcgcgcaccgactgaggatcgtcataggtaaaaaactctttggttttgctgctatacagataaggcaccatcgcttccggatcccagtaacgcgtataatcgccgctggctaacatctctttcaggcgataccaggggttagtacccgtaaactgaccatcatcatcccacgcgccatgaacagtcgcggtacccggtgcaaacagacccggcaggcctttcactatttcggtcggctccacgttgccccagccgcgtccataccaggggatacccatcatcagtttattctttggcacttgccaggtagtggcatattccgtcattgcagacgcggtattgaatttctgatcttcatctttgctgttggcatgaagcggcgcgttatgaccggtgatcggatcgaatgagccgtggaagtcataggccataacgttgacagaatcgagcagcgccgtgttttccgccagattgatatactgcatcttactgtggctggcggtaacagctgcggaaagctgataatatttatcatctttaatgccctgatcgtcgagtttgctgcgcaacgacttaatcagtttagtaaactggcttttatccgcttcggtatccggatattcccagtcaacatccaccccgtcaaagccccaggtcagcatataattgacaatgctattagccagcttctcgacaccagcatccgtggcggtcgcggtttcaaattctccttccagcgagttattccagcccccgacagaaataatattggtgacgcctgcggcttcggtacgcttatccagatctctcatcagaccgggaccttgctcagtatcatgggtgatgacttcaccatttttcacaataccaaagccgtaattcaggtgggtgatcttactgtaatcaattttgtccggcgtaaaattacggtgcgcgtcatagacaccccattccgggaaatagccgtaaattttacgttgtccggcaactttcgctttctgttcgttttggaaatcaatcgccgcctgaccggtataaggcgtaaagtcgaatatacccagcgtttggatatttatctcagtacctctctcccagacgctgtcaacacccggatattcaccaggatttacccaccacttactggtccagtagtggttgtcatagcgaacaactgttccggtcgtcgggtaagactggctcggatcgtatattggcgtctcaatgaccttatcgtcttttaccgcgacggtaacggtcacattgcccggaaagttatcttgattttcattctggtaagcaatccaggtggcgccgttgtctttcgaaagcatctgactggcatccaggcctgtgatggtattagtctgatcgttagcgattaatgttgcagccgatgctgcaaatgggaaacccactgttgcaagcaacagtgcgcccataattttattaaggtgcataataagttcctttaatattgttgtccgttctgtcgattcattgaaaacagtgatagtgatatacagagtcagacgcaatgaagtagtgccagcagttacacttttcactatcagcaacgttatagcactcccgaagcaacgggcctacaaaataggcctgcaataccagcaaataggaaattagcccggaatttattcttaaaaacaataaaaagcattattcagcaagaaatgacatataatttatttttcggatgaaatattaacgaaatgggaaattatataaattaagcaacaaaaagaatttttaatttactaaatgtaatgtccaaataagttatttcttattagaacggtaatacgattgcaggggataagagaaaggctaaacagagggacatagcacgacgctgtctgcagacggtaatttgcaacaggcagcttcgcagtagtgacaggaactcaggcgatttctttaaactcaggttgcttcatcagctcatcttccatgatttcacgcgccgcacgtacgcacttcccgcactgattgccaaccggtatgaacttcctcaattgctgaaatgactgaggactaaactggcgtaccgcctgacggatctttttatcgctcacgccattacacagacaaatgtacatatgcactcccgttcaaaatctacccagattgtaaatgagaatggttatgatttcaatgccagaaaagagggtggtatggaacagggcacaacgtaaaaaagccgcctgcaagcaggcggcataacattttatacaagctgttatttcagcatatcggcagtaacgacaatttttgcaatggtcgccggattcggggaggtacgctcaaccaccacagtttcgcctacggagatatcccgctcatctgatttcacaaccatagtgtcgcccttatcactgacggaactgtaaaaacaggaaccattgtcgcaactgaaaatgtaattcccttttttcttgtcatcatcgataactttcgcaatataagatgagccgtcggcactcttcagcttatcttttgcaaactcgacaagaacgtagggaatattattttcctggataactttcaaggatttaacgtcgccgtcgttaacaaccggattatttccttgcagcatatcttcggtaacgatcagctcgccgatgacggctgggttaggctgagtacgtttaacagtgattttggccccggggtgcaggatataagccgcattacctgtgcgtaaagacacctctttaccgtagttgtagcgatatgagtagtaagctgttgccccttccgtggagaagagatactgcccgtcaacttccacacggtaggcattaccaggagacaacttagacgcatcgaggttgataacgacacgctgttgattatcaaacagggtgacaaacaaccctttcagatccggatcacgcgcaggcgtcgtgatgatctctttcacaatgttgcccagttcatgctccggcgtatcgccgctcagatcccagacaatagcgccgccgtagccttcctgattgatgtaatcaactttttcccggattgactgcggatcgtcgtaagtcaaaaactctttagttgcactattgtacaaataaggcactcgcgattcaggatcccaataacgggtatactgaccgttattcaccagacctttcaggtaataccatgggttggtaccagtgtactgtccgttgtcatcccactggccatgtatagtagccgtgcccggcgcaaacaaccctggcaaccccttcacaatttcggtgggttccacgttgccccaaccacgtccataccaggccagtcccatcatcagtttagatttaggcactttccaggtggtgctgtaggcggtcattgccgatgctgagttgaattccagatcggcatccttgctgttggcgaacaacggtgagttgtggccagtgatcggatcaaatgcgctatggaagtcataagacatgacgttaaccgaatcaagcagcggtaccgtctcagccggattgatatactggatcttattgtggtttgccgttaccgcggcagaaagctgatagtagcgatcttcttttacaccctcggcgtccagtttagtgcgcagggacttaatcagcctggtgaactgggttttctcggcgtcggtatccgggtactcccagtcgatatcaacgccatcaaatccccaggtcatcatgtaagagacaatgctgttagccagcttttcgatacctgcatcagtggcggttgcagcttcaaactggccctcttcggagttgttccaaccacccacggagagaatattggttacgcccgccagctccgtgcgctgatccagctcgcgcatcaaaccaggccctttttcggtgtcatgtgtcactacaacgccctgcttaaccaccgcaaagccataattcaggtgcgtaatgccagtataatcaattttatccggggtaaagttcttatgcgcgtcatacacgccccactccgggaagtaaccatagacttttcgttgtgcagccactttccctttttgctcattctgaaaatccacggctgcctggccggtataaggcgtgaaggtaaaggtcgccagagtattgattttcacttccttaccctgcagccatacgctattgctgccgggcatttcacctggatttacccaccactggctggtccagtaataaccattgtaacgaaccaccgtgcctgctgtagggtaagactgggatggatcataggtctgagaattaattaccttgtcgtcttttacggccaccatgaccacgacattacccgggaagttattctgattctcggtgctgtacgccagccaggtatttccattgtccttagataacatctggctggcgtcaagtccgctaatggtattcgtttgatcgttcgcggttagtgtacccgcagatgcggcgaagggggtacatgccagcgccattaatagcgccagggtatgctttttaaaatgcatggtaaaatccctctttaatatattcatgaaactcatacttaatactttttggtgaaagtagtaataaaaaattcaggacctcatactctcacttttattgtttcagtgtttactcaagggatcaattaacctttcctttaaaattaagatattaataataaatattaaggttttccttaatttgatatttgcgatatttatcattttcgcctaagcgttaacgcacacaataaaagcatcagctggaagaatagtttatttattacaaaagaaaataatatacaaaaatttgattatttatattaagcgccgttgttaaacgcgccgtaaagggatgagagggattaaaacagccaataaacaggaaaaaaaaatgccagccacataagtggctggcattcatgtcacattaaccccgaaaggttaagttcagcggcaattagcccagaactttagcaacaacgcccgcgccaacggtacggccgccttcacggattgcgaaacgcagaccgtcgtccatcgcgatcgggtggatcagggtaacaaccattttgatgttgtcgcccggcattaccatctcaacgccttccggcagttcgatggtgccagtcacgtcagttgtacggaagtagaactgcggacggtagcctttgaagaacggagtatgacggccgccttcatctttggacaggatgtaaacttcagatt

SEQ ID NO: 9 - DNA, 27221 bp, Enterobacter sp SA187
gcgtatattacgctttcctctttcagagtcaaccctcaatttcaggattttttctcttcaaccgaaccggctgtttgtgtgaagtgattcacatccgccgtgtcgatggaggcgcattatagggagttctgaaggcaccgcaatacctaaatgacagaaaaatgactgactgctgcattccacagcaaaaccccgccttatacccatttacgcacagagttatccacaaagcggtgaaacgctaaaaattcgcgagcgttgcgcaaacgttttcgttacaatgcccgcgctaaaacaaggatgccccgtctggggcgttagctgaattttaggaagaaagaaaaccgaaaattcagctaacgctctctgtaatgtccaaatcctggggatttaataccatgcaacaacgtcgtccagtccgccgcgctctgctcagtgtttctgacaaagcgggtatcatcgaatttgcacaggccctctcctcgcgtggcgtggagctgctatccaccggcggtaccgcacgcctgctggcagagaaaggcctgccggtcaccgaagtatccgactacaccggcttcccggaaatgatggatggacgcgtcaaaacgctgcacccgaaagtgcacggcggtattctgggtcgtcgcggacaagatgatgaaatcatggcgcagcacgacatctctccaatcgatatggttgttgtgaacctttacccgttcgccgccaccgtcgcacgcgagggctgcacgctggaagacgcggtagagaacattgatattggcggcccgaccatggtgcgctctgctgccaagaaccataaagacgtggctatcgtggttaagagcagcgactatcacgccattattaatgagatggatgctaacgacggctctctgacccttgctacccgttttgacctcgccattaaagccttcgaacacactgccgcctacgacagcatgatcgccaactacttcggcagcctggtccctgcttatcacggcgacagcaaagatcctgctggccgcttcccgcgcaccctgaatctgaacttcattaagaagcaggatatgcgctacggtgagaacagccaccagcaggccgccttctatatagaagaagaaattaaagaagcctcggttgccactgccactcaggtacagggcaaggcactctcttataacaacatcgccgataccgatgctgcgctggaatgtgtgaaagagttcagcgaaccggcctgtgtgatcgttaaacatgctaacccgtgcggcgtggcggtcagcgattcgatcctcgacgcttacgatcgtgcgtataaaaccgacccgacctccgcgttcggcggcatcatcgcctttaaccgcgagctggatgcggaaacggcgcaggccattatttcccgccagtttgttgaagtgatcatcgccccgtcagccactgaagaagcgctgaaaattaccgccgccaaacagaacgtgcgcgtgctggtttgcggcgaatggtctgcccgcgtcgcaggtctggatttcaaacgtgtgaatggcggtctgctggtacaggatcgcgatctgggcatggtgagcgaagcagagttgcgcgtggtcagcaaacgccagccgagcgagcaggaactgcgtgacgcgctgttctgctggaaagtcgccaagttcgttaagtccaacgccattgtctatgccagagagaatatgaccatcggcattggcgcgggtcagatgagccgcgtgtactccgcgaaaatcgccggtattaaagcaggtgatgaaggactggaagtgaaaggctccgcgatggcctctgacgccttcttcccgttccgcgatggtattgatgccgctgcggccgtaggcgtaagctgcgtgatccagcctggcggttccattcgtgatgatgaagtgattgcggcggccgacgaacacggtatcgccatgatcttcaccgacatgcgccacttccgccactaatcccggagcagataatgaaagtattagttattggtaatggcggacgcgagcacgcgctggcgtggaaagccgcccaatcacctttagtagaaaccgtttttgtcgcaccgggtaacgccggtacggcgctggagccgatgctgcaaaacgtggcgattggcgcgaccgatattccggcgctgttgaattttgcccaaagcgagcacattgacctgaccatcgttggcccggaagccccgctggtactgggcgtggtcgatgcttttcgcgcggccggcctgaccatctttggtccgacgcagggcgccgcccagctggaaggttccaaagctttcaccaaagacttcctcgcccgtcaccacattccgacggcggaataccagaactttaccgaggttgagcctgcgctggcgtatctgcgcgagaaaggcgcgccgattgttatcaaagcggacggtctggcggcaggtaaaggagtgattgtcgccatgacgctggaagaagcggaagccgcggttcaggatatgctggctggcaacgcctttggcgacgcggggcaccgtatcgtgattgaagagtttctggatggcgaagaagccagctttatcgtgatggtggatggcgaacacgtgttgccgatggccaccagccaggatcacaagcgcgttggcgatgccgataccgggccgaataccggcggtatgggcgcttactcgccggccccggtagtgactgatgaagttcaccagcgcactatggatcgcgtgatctggccaacggtgcgcggtatggcagcggaaggcaatacctacaccggcttcctgtacgccggtctgatgatcgacaagcagggcaacccgaaagtaatcgagtttaactgccgctttggcgatccggaaacccagccgatcatgctgcgcatgaagtccgatctggtcgaactgtgcctggcggcctgtgaaggcaaactggatgagaaaacctcggagtgggacgaacgcgcatcgctgggcgtggtgatcgccgcaggcggttatccgggtgattatcgtaccggtgatgtgatccacggcctgccgctggaagaagtaggcggtaaggtgttccatgcgggcacaacgcttgcggacgacgaccgtgtgctgactaacggcggccgcgtgctgtgcgccacggcgctgggacatacggtggcggaagcgcagaaaaacgcttatacgctgatggcagatattcactgggacggcagcttcagccgccgggatattggttatcgcgcgattgcccgcgagcaggggaagtaatttccccctcaccctaatcctctcccgcagggagaggaaacagatcgccctctctttcaggagagggtttactcagaaattcttttcctgcggctgccaggtacagtaatcctcattcgccaccagcagcagctgtgcgccttccggcgcttccagccatgcgacgctcacttccgccgaagaatggcgctgacgccgttctatatggcttaacgcctgctcatcgaattccggtttaactgtctgcccttcgcaggtactgacgctgtggtcggcatgccagcgcccctgacgcagtatcacctgcccctggcgcagcgcatcgctggtctggcggatctgatcggcacgatagcggtacagcgcgatctggtcgctggaaagctgttgcttctgaccgttcacttcccgctgcataaaactgagttcgccgtggtcatcaaaacgcacgcgaatatgttccggctgtttgccgtagatagtaagttcgataagggcaagggtatcgccctgccagcggtattcgctggttgaggtatctccgcttcgccacgggctgaaggcagagagaatatggacgtcgtcatcgacatctttacgccacaggcgtacggcaccctgatcgcctgcgtaaccgctggcggtaaagggcggcggtgacgagtcatggctacaggctgtcagcaataatgcgccagccagcgccagcggacggcaccagaatgacaaaaggggcgaaaacgccccctcgttaaaactgttcgctgccacgcggtcttacttaacggcgtctttcagtgctttaccagaaacaaatgccggcacgttagctgcggcgattttgatttctttaccggtctgcgggttgcggccagtacgctcagcgcggtggttcactttgaaggtaccgaaaccaaccagttgtacagcatcgccttctttcagagactcagtaatagcagccagggtggattccagagcagctttcgcctgcactttagacagatcagccttgtccgcaattacatcaatcagttgagtcttgttcataagttatccttacaatgtgtttatcgcttgctaagcatcgagtgcgacggaaatgccaaaaaagcgccctcctgcatacacgcaccgatagccactttttttcgccccccaaatgtagaccagacggggggctaatgggaagccttgcagtatgacaaatcaggcgttaaatcacgttttcttgtctcattgctgcaaatttataccgatattgctttcccccgcctcgcgcaggtccgcgcgcagacctttgatcagctcaaggtcgcgctcttcgcagtcggccagcaggcggaaaatctcccactgaatgtcccattcctgctcgacagccgggttaagttttagctcttcatcggtcatttcccgacctgcctgggtcatttccagcatcgctaccgtggtgatggaggttttgctgacttcaatagcatgctccagcgtatcgccgcttaacagcgaatgcagcatttcactcaatgccacacaggcatcgatagccggataaacgccatacatatcgtaatcgtccgccgacgggatcgcttcctccagcttttccagctggctgtcgaaattgatcttcgcgtctttaacggtcagcgtttcccagacgagatcgaccatacggcgatagagttgtgcatcgccaaagccggtttgctggcagaacatggcgtagttcgggtacatgcgctcgcaaaggcaggccatgaaagtgacgtgctgccagctttccagcttctccagccgcaggtgaatcgggttttgtaacatgatgaattctcaatatcggaaattagccgcagtgtacctgaatcaggggtgaatttcctgccagcgcacaaaggccggacgacgcgaggcaacggcatccgcccagcgcgtcggctccggtaaacggtagcctttggtacagcgctgcacccaggccagcgcagtgtcctgactgacccgatggccggtggcgataaacagcgggttacagcgcgctttgctgcgccatacccacgccagatcctcacccttatcacgcagcggcgccagcgcgcctggctcgtcagacagcggctcaaacttaccgcacaggcgttttttcgccacgccgatggtcggcacatccaccagcagaccaaaatgactggccacgcccagacgacgtggatgcgaaatgccatgcccgtcgacgaacagcagatcgggtttttgcgacagcatatcccacgccgccagcagcgcaggatattcacgaaacgagaggaaaccaggaatatagggcatggtagtggcgatacgcgcgatctgatattcaaccagttcaagttccggatacgtcagcagtaccatcgccgcgcgtgttacttctccgccctgctcaaatcccacatctgccccgccgatcagtctcggcggatcggtaataaaacgatcttcccggcataccgaggaagccagttccagttgttgtgcgcgtaatgacgccagatccatacctgctccttattgatgatagggctgtgaaagacggtgtaccgcctccacaaaagcacctgcatgctccggaggaacatcctgatggataccgtgaccgaggttaaacacgtggccttccccctgaccaaagccagccaggatagtcgccacttcctcttcaatgcgtgcaggctgtgcataaagcatggacgggtccatgttgccctgcaacgcgactttatgaccgacgcgacgacgcgcatcggcaatatcgatagtccagtcgagacccagcgcatcgcagccggtttccgccatcgcttccagccactgaccgccgcctttggtaaagagcgttaccggcacgcggcggccttcgttttcacgcagcaggccatcgacaattttatgcatgtaatagagagagaattgctgataatcgcgcccggtcagcacgccgccccaggtatcgaaaatcatcaccgactgcgcgcccgcgcggatctgcgcgttgagatagagcgtgacgcttttcgccagcttatcgagcagcgcatgcaaggtcagcggctcggcgtacatcatttttttgatcagcgtaaaggctttgctgctgccgccttccaccatgtaggtcgccagcgtccacgggctgccggagaagccaatcagcggcacttcgcctttcagttcgcggcggatggtgcgcaccgcgttcatcacgtaacccagttcatcttccggatccggcaccggcagtttttcgacgtcggctttacaggtgatgggcgaggtaaaacgcgggccttcgccggcttcaaagtagaggcccagacccatcgcatcggggatggtcagaatgtccgaaaaaaggatcgccgcatcaagcgggaaacggcgcagcggttgcagggtgacttcgcacgccagctccgcatttttacacagcgacataaagtcaccggcttgcgcgcgggtggctttgtactccggcaagtagcggccagcctgtctcatcatccataccggggtgacatccaccggcaggcgctggagcgcgcgcaggtaacgatcgtttttcagttcggtcattttgcagttcctcaatgcgtcagaccgtcattgtaacatgtcactcatactctgcccgacacaaagccacggtgtcctcgatcaaacggcgcgcgactgtgcctggcggcggtaacaacggcagcgcatcatagcgataccagcctgcatccagcagttcgttagggtcgatgttgatttcaccgctgtcatactcggccataaaggcggtcatcagcgattgcgggaacggccagggttgcgaggtaacgtagcgcagatttttcacgcggatggcgctctcttccatgacttcgcgggccaccgcctgctccagcgtttcgcccacttcgacaaacccggccaaaacggtatagatgccgttacggtggcgcgtgtgctgggccagcaggattttgtcttcccggcggatggcgacaatgatgcacggcgcgatttgcgggtaataacgttcacgacagttgccgcacagcatcgcccactcgcttttactggtgtgcatggtgtgcccgcagtaaccgcaaaactggtgcgagcggtaaaactccgccagttgcacgccgcgcccggcgagctggaacagcccgacatcctgatccattaattgccgcacggatgacatatcctgacgacgattctgacgcaccagccacaccggctcgccctgccattcgccgatggttaaaccgcgctgacccacaagatcaaaatttcctgcctcgccatgtggtaattctccagcgggcagccataatttttgttcatggctgacaatccaccagccctgatcggttaattcgatgacacgttccataatctgttgcactaccttagcgacactggcatgttggtaacatcatttttacaaattttgggtaagtattttttaatcttaatattacggagttgatcatgctaaaccagctacaaagcctgacagagcgagtgggaggaagtaataaacttgtcgaccattggttacatgtccgtaagcatctgcttgttgcttattacgatctggtcggcattaaacctggcagagaatcctttacagaactcgatgaaaaagcgctggatgatttttgccatagcctggtcgattatctttccgctggtcattttagtatttatgaacgcattatcagcgaaatggaagggaccagcccacttttcgccgccacgcagatctatcctctgctggaagcgaacacgcagcagatcatgaattattatgattccagcctggaaaatgccattgatgacagcaactgcattgaattccagcatgcgctgtccggcattggcgaagcgctggcgcaacgctttacccttgaagatcaattgatcgttctggcgttcgacttcaacctttctgaaagcgccaacgacgaggcagtaaccaataacgagagagatatggctcgtcctgcttgagttctgcggcagtaacacgtaatttattttagctttcccgtataacgggaaattatttcttgtcggagtgccgcgtacgacagtaccggctgagaccgttaattcgggatccgcggaacctgatcaggttagtacctgcgaagggaacaagagttcatctgcatggcatcgctgcatccggcgatcgccctcttgcttcatccgtcattctgacaagccacgtccttacttttatggaatgagctatgtctgccactaaaccaacacgtcgccagcaacgcgaacacgcccagcgctttatcgatactctggaaggtactgtcttccccggctcccgacgcatctatattcagggttcacagccggacattcgcgtgcccatgcgtgaaattcagctcagcccgacgccagtcggcggcactaaagacgcgccacgttttgaagaaaacgaagcgatcccggtgtatgacacctccggtccgtacggcgatcccgccattactattaacgtccggcaggggctgaccaggctgcgaagcccgtggattgcagcgcgtggcgcgacggcaggccagtgcgtgacccagttgcactatgcccgccaggggattgtcacgccggagatggaatttatcgccatccgtgaaaacatgggccgcgagcgcattcgcgctgatgtcctgcgccagcagcatactggcgaaggctttggcgcgcgcctgccggaaaacatcacccctgaatttgtacgtgatgaagtggccgccgggcgcgccattattcccgccaacatcaaccaccccgaatccgagccgatgatcattggccgcaacttcctggtaaaagtaaacgccaatattggtaattcggcggtcagctcctccatcgaagaggaagtggaaaagctggtgtgggccacgcgttggggggctgacaccgtgatggatctctccaccggccgtaatattcatgaaacccgcgaatggatcctgcgcaacagcccggtccccatcggcacggtgccggtttatcaagcgctggagaaggtcaacggcattgcggaaaacttaagctgggaagtattccgcgaaacgctgctggagcaggcggaacagggcgtcgattacttcactattcacgccggtgtgctgctgcgttatgtgccgatgacggcaaaacgtctgacgggtatcgtttcccgtggcggctcgatcatggcgaaatggtgcctgtcccatcatcaggaaaatttcctttacgaacgtttccgcgacatctgcgaaatctgcgcggcctatgacgtctccctgtcgctgggggacggcctgcgtcccggctccattcaggacgctaacgacgaagcgcagtttgcggaactgcacacccttggcgagctgacgaaaatcgcctgggagtacgacgtgcaggtgatgattgaaggccccggccatgtgccgatgcatatgatccgccgcaatatgaccgaacagctggagcactgccacgaagcgcctttctacaccctcggcccgctgaccaccgatattgcgccgggctacgaccatttcacctccggcattggcgcggcgatgatcggctggtttggctgcgcgatgctctgttacgtaacgccaaaagagcacctcggcctgccgaacaaagaggacgtcaaacagggattaatcacctataagatcgccgctcacgccgccgatttagccaaaggccatcctggggcgcagatccgcgataacgccatgtccaaagcgcgctttgaattccgctgggaagatcagtttaacctcgcgctcgatcccttcaccgcccgcgcttatcacgatgagacgctgccgcaggagtccggcaaagtggcgcacttctgttcgatgtgcggcccgaaattctgctcgatgaagatcagccaggaagtgcgcgactttgcggcaaagcaggcggttgacgccggcatggcagataaatcgaacgacttccgcgcccggggcggcgaaatctatctccggcaggaggaggcgtaatgtaccagcctgattttccgccggtacccttccggctcggactttatcccgtggtggacagcgtgacctggatcgagcgtctgctcggcgccggggtgcgcactctgcaactgcgcatcaaggataagcgcgatgaggaggtggaagccgatgttatcgccgctatcgcccttggccgccgctatcaggcgcggctgttcattaacgattactggcggctggcgatcaaacatggcgcttacggcgtgcaccttgggcaggaggatttacaggacaccgatttggcggcgatccgcgcggcaggtttacgccttggcgtatcgacccatgacgatatggaaatcgacgtcgcgctggcggcaaaaccgtcctatatcgccctcggccatgtcttcccgacgcaaaccaaacagatgccttctgccccgcaggggctggcacagctggcgcagcatatcgcccggctgaaagattatccgacggtcgccatcggcggtatcagcactgaacgcgcgcctgcggtactggcgaccggcgtgggcagcatcgcggtggtcagcgccatcaccgctgccgatgactggcaggcggcaacccggcagttgctggatctggcgggggtgggcgatgaatgacaatgatttcatgcgctacagccgccagatcctgctggaagacatcgccattgacgggcagcaaaaattgcttgccagccgggtgctgattgtcgggcttggcgggctcggctctccggcggcgctgtatctggcggcggcaggcgtgggaacgctggcgctcgccgatgacgacgcggtgcacctcagtaatctgcaacggcagatcctcttcaccacagaggatattaatcgcccaaaatcacaggccgcggcgcagcgcttacagcagctcaatccggacactgaactgatcgccctgaatcagcgtttagcgggcgatgcgctgcatcaggaagtggcccgtgccgatgtggtgctggattgtagtgataacatgaccacccgtcaggcgattaatgccgcctgcgtggcgaacaatacgccgctcgtcagcgcaagcgcggtgggctttggcgggcagttgatggtgctgacgccgccctggacgcagggctgctatcgctgcctgtggccggatgacgttgagcctgaacgcaactgccgcactgctggcgtcatcgggccggtggtgggcgtgatgggcagcctgcaggcgctggaagccatcaagctgttaaccggcataacgcctgcgcaaggtgaactgcggctgttcgatgcccgcagccatcactggcgcaccatcacccttcagcgggcggcaaactgcccggcgtgcggaggtctgcatgcgcattctgtttaatgatgagccgatgcagtgcgccgacgcgctgaccgtcagcgccctgctgacgcagcttaatcagctgacgcctggcatggcgctggcgctcaatcagcacatccttccccgggatcgctgggatcaacaactgttgcaggacggcgatcggatcctgctttttcaggtcatcgccggaggctgatatgttacgcattgctgataaaacctttacttcgcacctttttaccgggacggggaaattcgcctcacccgcgctgatgatgaacgcgatacgcgcctccggtagccagctggtcaccctggcgatgaagcgcgtcgatttgcgccagcgcagcgatgacctgctggcgccgttgctggaggccggggtgacgctgttgcctaatacttccggggcaaagaatgccgaagaagccgtgtttgccgcacagctggcaagggaggcgctcggcacaaactggctgaagctggagatccacccggatccgcgttggctattgcccgatcccatcgaaaccctgaaagccgcggagattctggtaaagcagggctttatcgtgctgccctattgcagcgccgatccggtgttatgcaaacggctggaggaagcgggctgcgcggcggtaatgccgctgggcgcgcctatcggctccaatcaggggctggaaacccgcgcgatgctggaaatcatcatcgctcaggctggcgtgcccgtggtggtggatgccgggataggcgcccccagccatgcggcacaggcgctggaaatgggcgcggatgcggtgctggtgaataccgccattgccgtggctgacgatccggtgaaaatggctcatgcattccgcctcgccgttgaagccggcgtgctggcgcgtgaagcggtgccgggcgcccggcactccttcgcacaggccaccagcccgctgaccggttttctggaggcgcagccatgaataccttcactgaccgctggcggcagctggactgggatgacatccgcctgcgtattcacagtaaaaccgcccgggacgtcgaacgggcgctcagcgccacgcagctcacccgcgaggatatgatggcgctgctctcccccgccgccagcgcgtttctggagccgctggcgcaacgttcgcagcaactgacccgccagcgttttggcaacacggtcagtttctacgtgccgctgtatctgtcaaacctctgtgctaacgactgcacttactgcggcttttcgatgagcaaccgcattaagcgcaagacactcgacgacgatgagatcgcccgcgagtgcgccgccatccgtcagatgggctttgaacacattttgctggtgaccggcgagcatgaaaagaaaaccggtatggactatttccgccagcagatcccggcgattcgccgccagttcgcctcgctgcatatggaagtgcagccgctgtcgcaggcggagtatgcggagctgaaagcgctcggcctcgacggtgtgatggtgtatcaggagacttatcatgaaggggtttacgccaggcaccatctgaaaggcaaaaagcaggacttcttctggcggctggagaccccggaccggctgggccgcgcgggtatcgataaaatcgggcttggcgcattgatcggtttgtcggatgactggcgggtggactgctttatggtggcggagcatctgctgtggctgcaaaaacagtactggcagagccgctattccatctctttcccgcgactgcgcccctgcaccggcggtattgaacccgcctccatcatggacgaacgccaactggtacaaaccctgtgcgcgtttcgcctgttcgcgccggaggtggaactgtcgctgtcaacgcgggaatcgccctggttccgcgataacgtgatcccgctggcggtgaacaacgtgagtgcgttttcgaaaacgcagcccggcggctatgctgacgaccacccggaactggagcagttcgcgccccatgacgggcgtcgcccgcaagaggtggcaagcgcgctgatgcgtcgtggtttacaacccgtatggaaagactgggacagctggctggggcgcaatttgtaaccggtttcaccttaagcgggtttctttgtgatgcccgacacacaatcactgcaaagcggttgttgatccccgggggtgggataattatcagttatcccatctacatcgaggctaactatgaaaaacatcgttttatgctgtgctgccggtatgtccaccagcatgttggttcaacgtatgaaagatgcggcgcagaaaaaaggcgtcgaggtgaccatcaaagccgttccggtggcggagtttaaggacaatatcgcaaccgccgatattgtcctgctgggaccccaggtgaaatatgaactggccaagcttcaggcgcaggctgagccgctgggcaaaaaggtcgccgttatcgatatgatggattacggcatgatgaaaggtgatgtcgtactggaaaaagcccttaagctgctggagtgatcgcatggaagatttggaaactatcatcatggaattgctggttaacgcgggcgcagcacgcagcgaagcgttaacggcgctacagctggcgcgtcagggggattttgcaggcgctgaggccgcgatgacggagtcgcgggaatacgttaagcatgcccataaaatccagacgcagctgataggtcttgatgaaggtgaaggcaaattgccggtgaatctgatcaccgtgcattcgcaggatcatctgatgaacgccatggtgattcaggatctggccggcgatatgattgaactgtatcgccgtttaccgcctttgaattgattgctgtctgaagagcaaaaaaaaacccgccgaagcgggttttttattatcgggctgttaacgattactcgttgtcagaaccgcccaggcctgcgttcagcagttctgccaggctggcagacgcgtcttcagcagtcacctgcggtgcagccgggagttcacccgcagcacgacggcgcatacgatcctgatggtacgcgtaaccggtaccagccgggatcagacgacccacgataacgttctctttcagaccgcgcagttcgtcgcgtttgcccgcaacggctgcttcggtaagcacacgagtggtctcctggaacgatgccgcggagatgaaggactcggttgccagagacgctttggtgatacccagcagatcgcgagcataggtcgctgcgattttgccgttcgcttccagttcgcggttagcgatcttgacgcgagagtattcagcctgctcaccttcgaggaagtcagagcttcctgcgttctcgatggtggctttacgcagcatctgacgcacgataacttcgatgtgcttatcgttgatcttaacgccctgcagacggtaaacgtcctgtacttcgttggtgatataacgcgtaacggcgtgaacaccacgaagacgcagaatgtcgtgcggcgcttccggaccatccgaaaccacatcaccacgttctacacgttcaccttcaaacacgttgagctgacgccatttcggtatcatctcttcgtacggctcgctgccatcaaccggggtgataaccagacgacgtttccctttggtttctttaccgaaggaaatgatgccgctgatttcagccaggattgccggctctttcggacgacgtgcttcgaacaggtcagcaacacgcggcagaccaccggtgatgtctttagtaccgccggattccatcggaatacgcgccagggtgtcaccaccgctgatctgtacgccgtcttccagctgcacaatcgctttacctggcaggaagtactgagctggcatatcggtaccagggatcagaacatcgttaccgttggcatcaacgattttcagcgccggacgcagatctttaccgcccgcggtacgttctgcagaatccagaaccaccagcgaagacagaccggtcagttcgtcggtctgacgagtaatcgtctggccgtcgatcatatcggtgaagcggatataacccgctacttcggtgataaccggcatggtgtgcggatcccagtttgctacggtttcgccgcctgcaacctgctcgccatcacccttcgccatgaccgcaccgtaaggcactttatagctttctttggtacgaccgaattcgtcgatcagtttcagctcggtgttacgggaggtcaccaccagtttaccgctggagttcacaaccgatttcgcgttgctgagacggatgctacctttgtttttcacttggatgctggattcagcagccgcacgagatgccgcaccaccgatgtggaacgtacgcatcgtcagctgtgtacccggctcaccgatggactgtgccgcgataacgccgattgcttcacctttgttgatgatgtggccacgcgccaggtcacgaccatagcagtgtgcacatacaccaaagtcggtgtcacaggatacaacggaacgcactttcacgctgtctacggagttcgcttccagcaggtcacaccattgctcatgcagcagcgtgttgcgtggaaccagaatgtccgcggtacctggtttcagtacgtcttcagcggtcacacgacccagaacgcgatcgcgcagcggctctttaacatcaccaccctcgataaccggggtcatggtgataccttcgagggtgccacaatcgtcttcggtaaccaccagatcctgcgcaacgtcaaccagacgacgcgtcagataaccggagttcgcggttttcagtgcggtatccgccagacctttacgcgcaccgtgcgtggagatgaagtactggagtacgttcagaccttcacggaagttcgcggtgatcggcgtttcgatgatggagccatccggcttcgccatcagaccacgcatacctgccagctgacgaatctgtgccgcagaaccacgcgcaccggagtcggccatcatgtaaatgctgttgaaggaaacctgctgctcttcgacgccgtcacggttaataacggtttcggtttgcaggttgtccatcatcgctttagatacacgatcgttcgccgcagcccagatatcgataactttgttatagcgttcgcccgcagttaccagaccagactggaactgttcctgaatttcagcaacttccgcttccgcttcgctgatgatttcagttttcttctcagggatcaccatatcgtcgataccaacggatgcacctgaacgcgctgcataagcaaagccggtgtacatcgtctggtcagcaaagataacggtcggtttcaggcccagaatgcggtaacaggtgttcagcattttggagatcgctttcttgcccagcgcctggttgacgatggagaaaggcagacctttcggtacgatcatccacaggatcgcacgaccaatggtcgtatcaatcaggctggttttcgcaacgaattcgccctgtgcatctttttcatactcggtgatacgcacttttacacgcgcatgcagagaggccaggccagcgcgataaatacgctcagcttctttcgggccagtcagcaccatgccttcgcctttggcgttaacacagtcacgggtcatgtagtacagacccagtacaacgtcctgagacggaacgatgattggttcgccgttcgccggagacagaatgttgttggtagacatcatcagcgcacgcgcttccagctgagcttcaagcgtcagcggaacgtgtactgccatctggtcaccatcgaagtcggcgttataagccgcacaaaccagcgggtgcagctggattgctttaccttcgatcagtaccggttcaaatgcctggatacccaaacggtgcagtgttggtgcacggttcagcagtaccgggtgttcgcggataacttcgtccaggatatcccaaacgacagcttcttcacgctcaaccattttcttggcggctttgatggtggtagcaagaccacgcagttccagcttgccgtagatgaacggtttgaacagctccagcgccattttcttcggcagaccgcactgatgcagacgcaggtatggacctacggtgataacagaacgaccggagtagtcaacacgcttaccgagcaggttctgacggaaacgaccctgtttacctttgatcatatcggccaaagatttcagaggacgcttgttagaaccggtgatcgcacgaccgcgacgaccgttatccagcagggcatctactgcttcctgcagcatacgtttttcgttacgtacaatgatgtccggcgcagccagatccagcagacgtttcagacggttgttacggttgataacgcgacgatacagatcgttcagatccgacgttgcgaaacgaccaccatccagcggtaccagcggacgcagatctggcggcagaaccggcagaacggtcaggatcatccactctggcttgttgccagacatcacgaatgcttccagcagtttgatacgcttggtcagctttttacgcttggtttcggagttagtttcgttcagctcttcacgcagctgctcgcactctttctccagatccatgcttttcagcagggcctggatcgcttccgcacccattttcgcgtcgaattcgtcaccgaactcttccagcgcgtccagatactgttcttcggtcaggatctggttacgttccagattggtcataccgccttcgataaccacataggattcgaagtacagaacacgttcgatatcgcgcagcggcatatccagcagcaggccgatacgggacggcagagatttcaggaaccagatgtgcgcagtcggagaggccagttcgatgtggcccatgcgctcacggcgcactttggtctgggtcacttcaacgccgcacttctcacagatcacaccacggtgtttcaggcgcttgtacttaccgcacaggcactcatagtcttttactggcccgaaaatacgcgcacagaaaaggccgtcacgctcaggtttgaacgtacggtagttgatggtttccggcttcttaacttcaccgaaagaccatgaacggatcatgtctggcgaggccagcgcaattttgatcgcatcaaactcttcggttttagtctgcgctttcagaaactttaataaatctttcacggatttgctcccgtcggagttagcacaatctggcgccgggagtgaccccggcaccagtgacctgtttgagcgagagttactcgtcttccagttcgatgttgatacccagcgaacggatctctttcaacagtacgttgaaggattccggcatgcccggttccatctgatggttaccgtccacgatgtttttatacatcttggtacgaccattaacgtcatcagacttaacggtgagcatttcctgcagggtgtatgccgcgccatatgcttccagcgcccacacttccatctccccgaagcgctgaccaccgaactgcgccttaccacccagcggctgctgagtaaccaggctgtaagaaccggtagaacgcgcatgcattttgtcatcaaccaggtggttcagtttcagcatgtacatatagccgacggtaacctggcgctcgaattgctcaccagtacggccgtcgaacagggtaatctgaccggaagtcggcaggccacccagctgtaacagttccttgatttcagactctttcgcaccgtcgaataccggcgttgcgatcggcatacctttacgcaggttctcagccagacgcagaacttcttcatcagtgaaggtgttcaggtcaactttctgacgaacgtcggagcccagatcgtaagcacgctggatgaattcgcgcagtttcgcgacttcctgctgctgtttcagcatggcgttgatcttatcgccgatacctttagcagccatacccaggtgagtttccaggatctgaccgatgttcatacgagacggtacgcccagcgggttcagtacgatgtctaccggcgtgccgttttcatcgtaaggcatatcttcgatcgggttgatcttagagataacacccttgttaccgtgacgacccgccattttgtcaccaggctggatctgacgtttaacggccagatacactttaacgattttcagcacgcccggtgccaggtcatcgccctgagtgattttgcgacgtttcgcttcgagttttttctcgaactcgtgcttcagttcgtcatactgctcagccagctgttccagctgattttgtttgctttcgtcggtcagaccgagttccagccagcggtcgcgcggcagtttgtcgagcttctcagcttcaacgccaccggaaaccagcacggcatggatacggctgaacaggccagcttcgaggatctgcaattcttcagacaggtcttttttcgcctgcttcagctgcatctcttcgatttccagcgcacgtttgtctttttccacgccatcgcgggtaaagacctgaacgtcgataacggtaccggaaacgccgttcggcacacgcagagaagagtctttaacgtcagacgctttctcaccgaagatcgcacgcagcagtttttcttccggcgtcagctgggtttcacctttcggcgtcaccttgcccaccagaatgtcgccgccggtcacttctgcaccgatgtaaacgataccggattcatccagtttggagagcgctgcttcacccacgttcgggatgtcggcggtgatctcttccggccccagcttggtgtcacgggacacacatgccagttcctgaatatggatggtagtgaaacgatcttcctgaaccacacgctcggagacaaggatggagtcttcgaagttataaccattccacggcatgaaggctacgcgcatgttctgaccgagcgccagttcaccgaggtcggtggacggaccgtctgccagcacgtcgccgcgctcaattggctcacccagagatacgcaaggcatctggttgatgcaggtgttctggttagaacgggtgtatttggtcaggttataaatgtcgatacctgcttcgcccgggtacatctcgtcttcgttaactttgataacgatacgggaagcatccacgtactgaacagtaccgccacgcttagcaacagcagtaacaccggagtcaacggcaacagcacgttccataccagtaccaaccagcggcttatcagcgcgcagagtcggaacggcctgacgttgcatgttcgcacccatcaatgcacggttggcgtcatcgtgttccaggaacgggatcagggacgcaccgacggaaaccacctgctgggtggaaacgtccatgtagtcaacctggtcgttgctgaacaagctggattcgcctttgctacggcaggtaacgagatcgtcaacaaagcgaccttcttcatccaggttggtgttcgcctgagcgataacgtagttaccttcttcgatagcagaaaggtaatggatctcgtcagtcaccacgccgtcagtcactttacgatacggagtctcaaggaagccgtattcgttagtctgtgcataaacggacagggagttgatcagaccgatgttcggaccttcaggcgtttcgattggacatacgcgaccgtagtgagtcgggtgtacgtctcgaacttcaaagcctgcgcgctcacgggtcagaccgcccgggccgagtgcggagatacgacgcttgtgcgtgatctcagacagcgggttgttctggtccataaactgagacagctggctggaaccgaagaactctttcactgctgcggaaatcggcttggcgttgatcatatcctgaggcatcagggtatccagatcgcccagagacagacgctctttcaccgcacgctctacacgtaccagaccaacgcggaactggttttccgccatttcgccaacggaacggatacgacggttgccgaggtggtcgatatcgtccacttcgcctttaccgttacggataccgatgagcttcttcatcacttcaatgatgtcgtctttgctcaggataccggaaccttcgatttcgtcgcgcagcaaagaacggttgaacttcatacgaccaaccgcagacagatcatagcggtcttcggagaagaacaggttctcgaacaggctttcagccgcttcgcgcgtcggtggttcacctgggcgcatcatgcggtagatttcaaccagcgcgctcagacgatcgttggttgggtcgacacggatagtctcagaaatgtaagcgccgtgatccaggtcgttggtaaacagcgtttcgatacgcttatgaccggcctggctcagcttcgccagcagatccagagagagttccatgtttgctgcgcaaatcagctcgccagtagactcatcaacgtagtctttagcggcaactttgcctgcaatgtactcaaccgggacttcaatcagtttgatatcgtctttttccagctggcgaatgtgacgcgcggtaatacgacgcgctttttccacatacactttgccgttagcttcgatgtcgaaggaggcggtttcaccacgaaggcgttccggcaccagttccatctgcagcttgttatcacgaatttcaaagacgactttttcaaagaacaggtcaaggatctgctcagtggtgtaattcagtgcacgcaggatgatagtcgctggcagtttgcggcgacggtcaatacgtacgaacaggttgtctttcggatcgaactcgaagtccagccatgaaccgcggtaaggaatgatacgcgcgttatacagcactttacctgaagagtgagttttacctttgtcgctgtcaaagaatacgccaggactacggtgaagctgagacacgataacgcgctcagtaccgttaataacaaaggtaccgttgtcggtcatgagcggaatttcgcccatgtaaacttcttgctctttgatgtctttaacggtgccttccggcgcttcgcgctcgtagatcaccagacgcagtttcacacgcagcggtgccgagtaggtcacgccacggatctggcattcttttacatcaaagacaggctcgccaagacggtaactgacgtattgcagttccgagttgccgctgtagctcgtgatcgggaacacggaacggaatgctgcttccagaccgtactgcccttcaggatcttgctcgataaacttctggaacgagtcaagctggatagaaaggagatatggaatgtccagcacttgcggacgttttccaaaatccttacgaatacgttttttctcggtataggagtaaaccattagggttcctcagctcgctgacaagtcgacccatctgcccgacgaaagggacagtttgtgcaacactattttgttgaccggaaagtggggcactttccgcaatgcttgttgctatcacgcttaaaccatttcgttgcgatttacacaaagcgcgagccttgtcgcaatatattaagtcgtcgatagaaacaagcattgtgaggggaagccagtagttaaacagtgtgaaacactaccgacaccctacagcgcaaaaaggctggtgaccaaaaagtcaccagccatcagcctgatttctcaggctgcaaccggaagggttggcttatttaacttcaacttcagcgccagcttcttccagagattttttcagagcttcagcgtcatctttgctcacgccttctttcagagaggccggagcagattctaccaggtctttagcttctttcagacccaggccagttgcgccacgtactgctttgatcacagcaactttgttagcgccaacagctttcagaataacgtcgaattcagttttctcttcagcagcttcagccgggccagcagcaacagctacagcggcagcagcagaaacaccgaatttttcttccattgcagagatcagttctacaacgtccattacggacatagcggatactgcttcaatgatttgatctttagtgatagacatttaaattgttcctgaatatcagaataagtttatacgtaagcaaatgctttacaaagataactgcgattaagcagcttctttggcatcgcgtacagcagccagagtacgaaccagtttgccagccgaagcttctttcatggttgccatcaggcgtgcaattgcttcttcgtaagtcggcagagttgccaggcgatcgatctgcgacgccggaatcaactcaccttcaaaggcagcggctttgacctcaaattttgcattcgctttcgcgaattctttgaacagacgagcagcagcgcccgggtgttccatagaatatgcaatcagggtcggaccaacgaacgcgtctttcaggcactcgaactgagtaccttcaacaacacggcgcagcagggtgttacgaacaacacgcatgtatacgccggcttcgcgacctgctttacgcagttcggtcattttatctacggtaacgccacgggaatccgcaacaaccgcagacagcgcgcctttggctacttcgctgacttcagcaacaatcgcttgtttgtcttgaagatttaaagccattagctttgctcctggatgtttgccagggcttatgccctggaactcacttcactcttctcaaagaaaagagcgtcttaatacggtgagcagaaacaagccaaagatacttataaaatgtcttcaggttctgtcaccgtctacgcagggaattaagtttcttgcgaaacacctgcggtcttggacggaggcctggattaggccaggctccaaccgaaaatcttttcgtgggcgaagattgtagacaaatccaccgcccacgtaaaggcgaatattagttcgccaccgcagtcagaccagactggtcaactgcaacacctgcacccatggtggtggagatgctaactttcttgatgtacacgcctttcgcctgagtcggttttgcttttttcagcgcaaccagcagagattccaggttttctttcagtttgtcagcgtcaaagtccactttaccgatggtggtgtggatgatgccgtttttgtcgttacggtaacgaacctgacccgctttagcgttcttaaccgcttcagcaacgttcggcgttacagtaccaactttcgggtttggcatcaggccacgcggacccagaacctggcccagctggccaacaacgcgcattgcatccggggaagcaataacaacgtcaaagttcatttcgcctttcttgatctgttctgccagatcttccatacctaccagctcagcgccagcagctttagctgcttcagcgttcgggccctgggtaaatacagctacgcgaactgaacggccagtaccgtgcggcagtacagttgcaccacgtacgttctggtcagatttacgagcatcgatgccgaggttaacagcaacgtcaacgctttcgttgaatttagcggtggccagctctttcagcagagcgatggcttcgttgatgtcgtactgtttggtcgcatcaactttctcacggatcacgcgcatgcgcttggtcagtttagccatttcttaatcctccactaccaggcccatggaacgcgcggtaccttcgatggagcgagtcatcgcttcaacgtctgcaccagtcatgtccgcggctttagtctgcgcgatttcctgcagctgagcgcgggagatcttgcccactttgtctttgttcggcttgccggaaccagacttgataccagccgctttcttcagcagaactgctgccggaggcgttttggtaacgaaagtgaaagaacggtcagcgtaaacggtaataacaaccgggatcggcagacctttctccatggaatcagttttcgcgttaaacgctttacagaattccatgatgttaacaccctgttgacccagagccggacctactggcggactcgggtttgccatgccagctgcaacctgcagcttgacgtaggcctggactttcttagccattgcaatttcctcgtgtgggtatagcgccttaaaaaggctccccgtgattaatactgtgtcttacgggtacatgacccgtaaaaacaaaaggcgcgaaattgtatgtcaatttcgcgccctgtgcaacgatttaatcgccgcttttttggtcggcaggttaggccttctctacctgtgcaaaatccagttctaccggcgttgcacggccaaagatggaaacagataccttaagacgggacttctcgtagtccacttcttcaaccacaccgttaaagtctgcaaacggaccatcgctaacgcgaaccatttcacccggctcgaacagcgttttcggacgtggcttgtcgccaacttgctgcagacgattcatgatggcatcgacttctttgtcgctgatcggcgccggacgatcggacgtcccaccgataaagcccatcacgcgcggtacgctgcgcaccaggtgccagctcgcatcgttcatgaccatttgaaccagaacgtaacccgggaagaatttgcgctcgctcttacgacgttggccaccacggatttcgaccacttcttcggtcggcaccatgacttcgccaaacaactcttccatattgtgtaatttgatatgctcacgcagcgacgtagctacgcggccttcaaaaccggaaaacgcctgaacgacgtaccagcgctttttaggggcttcagacatctcagaacctcaggccagtgataaaggataccaggcgaaccagaataccatccagtccccacaggatcagtgacataacagcagtaactgctgccacaatcagcgtggtgtgcaatgtttcctggcgagttggccaaatcactttacggacttcggttctcgcttcacgggcaaaagcaacggtcgctttacccttcgtcgtcaacagcgcgacaccacccgctgcagcaattaaaataacgactgccagcgcgcgtaacggcagcatcatgtcacgataaaggtagttgccaacgatagccacgatcagcagcgcagcaacaacaacccacttcatcgcttccaggccgcgcccgctcccttgagcttcggtattcgcactcataaaccaacctgtcacaagaattcagacaaacatttttgccccgccatagcgaggcaaccaaaccgaaatgctctattgcgcttcggacttaacgccctctacagagcctgtctcagcaatgattatgacgtataaaatcactgatgagccaggttctggttcgaaagcgtacaaaaagggcatcaaatgatgcccttttaatgcgcattgcgtcaaatgttatcagcgattagccaagaactttagcaacaacgcctgcgccaacggtacggccgccttcacggattgcgaaacgcagaccgtcgtccatcgcgatcgggtggatcagggtaacaaccattttgatgttgtcgcccggcattaccatctctacgccttccggcagttcgatggtgccagtcacgtcagttgtacggaagtagaactgcggacggtagcctttgaagaacggagtatgacggccgccttcatctttggacaggatgtaaacttcagatt

SEQ ID NO: 10 - DNA, 4596 bp, Enterobacter sp SA187
atttgcctggcggcactagcgcggcggtcccacctgaccccatgccgaactcagaagtgaaacgccgtagcgccgatggtagtgtggggtctccccatgcgagagtagggaactgccaggcatcaaacaaagcagaaggccattctcacggatggcctttttgcgtttggcgatctccctgacgccatcctccacacgactaaccacaagcgatcccgccatatatacggtaaactagccgtgtttttgtctctggatagcgtctatgaatcactcccttaagccctggaatacatttggtatagcgcgtcaggccgcacgcattgttcgtgcagagaatgagcaacagttactctctgcctggcaggaagcggtaaaaaatcagcgtccggttctgctactgggagaaggtagtaatgttcttttcctggaagactttgccggcaccgtcattgtgaaccgtattatgggcatcgaggcggtggaacgatcagatgcatggcatctgcacgtcggggcaggggaaaactggcataagtttgtccagtacacgctggataacggtatgcccgggcttgaaaaccttgcgctgatccccggctgtgtcggttcatctcctattcagaacattggcgcatacgggattgaactccagcgggtttgtgagtatgtcgactgtcttgagctcgagtccggtaaaaggctgcgtctgagcgctgcagagtgtcaattcggctatcgcgacagtgctttcaaacaccagtatcaggatcgttatgccatcgttgccgttggtttccgcctgtcaaaaacatggcagcctgtactgacctatggcgatttaacgcgccttgatccgcagagagtcacgcctctggatgtatttaattcggtgtgccacatgcgcatgacaaagcttccggatccaaaagtgaatggtaacgcaggcagctttttcaagaacccggttatcaccgctgagcaagcccaggcattgctggcgcagtttcctgccgccccgcactatcctcaggctgatggcagcgtgaagctggccgctggctggcttatcgatcagtgtgatttaaaaggaacgacgctgggcggcgcggctgtgcaccgtcagcaagctctggtgctgattaatactggcgacgccaccagtgacgatgtggtaaaactcgcccaccatgttcgccagcaggtcggtaataaatttagtgtctggctggagccggaagtgcgatttatcggccagacgggtgaagtaaatgcagtggagattatcgcgtgaaggacaataccattccattaactctgatctccattctggcagatggcgaatttcattctggcgaacagctgggtgaacatcttggcatgagcagggcggcgattaataagcatgtccagactttgcgtgactggggcgtagatgtctttaccgtgcctggtaaaggttacagtctgccagagccaatccagttgctggatgacgcatttatcagcgggcagtttaatgaggggaatattgccgttcttccggtaatagactcaacgaaccagtatctgatggatcgcatggatcaattacattctggtgatgcctgtgtggcggaatatcagcaggccggacgcggcagacgcggacggaagtggttttcacctttcggcgccaatctgtatctttccatgtactggcgtctggaacagggcccggctgccgctatggggctgagtctggttatcggtattgtcatggcagaggtattacaggcgctgggtgctgaagaggtgcgtgtaaaatggcccaacgatttataccttcaggacagaaagctcgcaggtattctggtggaactgaccggaaaaacgggggatgccgcacagatagttataggggcgggtattaacctcgccatgcgcaacgttgaagctgacattgtgaatcagggctggatcaacctccaggaggccgggatcgccgtggatcgcaatcagctggcagtacgcctcattagcgaactacgtgccgcactacacctgtttgaacaggaaggtttaagcccgtacctgatgcgctggaaaaagctggataactttattaaccggccggtgaagctaattatcggcgacaaagagatttacggtatttcccgcggtatcgacgctcagggggcattattacttgagcaggatggtattaccaagccatgggtcggtggcgaaatatcattaagaagtgccggataaaaaaaggagagcataatgctctcctttttgtttatttacgtaaacggacctgctctacggcgtgattggcgctcttggtcataatcagactggcgcgctcacgggtgggtagtatgttttcttttaaattcaacccgttaatctctttccacagggaggtggcaatattgaccgcttcttccgtcgatagtttggcatagttatggaaataagaatccgggttactaaaagccccttcacggaatttcaggaagcggttgatataccaggtctgtaataaatcttccggcgcatcaacataaatagagaagtcgacgaagtcagatacaaatacatgatgtggatcgtgtggataatccataccgctttgcagcacattcaaaccttcgagaataagaatatccggctgggttaccgtcttatcaccgtccgggatcacgtcatagatgaggtgtgaatatacgggcgcggtgacgttgggtacgcctgatttgagatccgagacaaatttcaccagccggtgcatatcataagaaagagggaaacccttcttcttcatcaacccgcgttctttcaacacttcattagggtggaggaagccatcggtggtaatcagctcaacgcggcgatgttcaggccagcggcttaacaacgcctgaagcacacgtgcagtggtgcttttacccacggctacgctgccggcaatactaatgatgtagggtatgcgttccccgttagtgcccagaaactgctccagtacggcctgacgacgcagattcgaactgatgtagaaattgagtaaacgtgacaacggcagataaatctctgcaacttcttccagagaaaggtcttcgttgatgccttttaaccgcgcgatttcaccttctgtcagggtcatcggcactgaatcacgaagggcagcccactggctgcggttaaactcaaggtaaggcgtcattaacgattgctcttttttactcataagcatatgtctgcctgccatgctcatttcccgctcaatcactgctgttcagtgagacaccgaatattcagaccgcgacaatggcacgctgcatgtaagttaaatttggacaatacgcaggagggtaacaccagatgaaaaggaataataagaaaaaatcacctcgacgggcggattcaaaggcgagcatcacgaaagcaggaatcaggtgagattgcgctataaaagagaagtacaaccttcgcacaggtaataagatagcgcgcggcgcacatagccttcttcaggctggcgaggatgatcggtttatgcgcggccttttcacctcacctacccctaacttgctgaataattgttctgctctgcatgaaattacagcatttttccatgctggcgcacaaaatgtgagcgatagaacgttttctgcgatttttttgttgcatgcaggcgcaggtctacctagaatgcgcgctacttgatgccgacttagctcagtaggtagagcaactgacttgtaatcagtaggtcaccagttcgattccggtagtcggcaccatcaagtccggtggggttcccgagcggccaaagggagcagactgtaaatctgccgtcacagacttcgaaggttcgaatccttcccccaccaccactttctggcagcgtaaaaactgtctgggctggttgaaagactaaccggctcaagcgaaaaagagacatgtctctttttttgtcacagaaagaactgggtagccgagtttcaggatgcgggcatcgtataatggctattacctcagccttccaagctgatgatgcgggttcgattcccgctgcccgctccagacgtgctgatatggctcagttggtagagcgcacccttggtaagggtgaggtccccagttcgactctgggtatcagcaccacttcacttctccttcccgtttctctctgtgtaagcttaaatattcaacatttcaggcatatcgcctggttgatgtggtgatatcaccgatttatccgtgtcttagagggacaatcgatgtctaaagaaaagtttgaacgtacaaaaccgcacgttaacgtcggtactatcggccacgttgaccatggcaaaactacactgaccgctgcaatcactaccgttctggctaaaacctacggtggttctgctcgtgcattcgaccagatcgataacgcgccggaagaaaaagctcgtggtatcaccatcaacacttctcacgttgaatacgacaccccgactcgccactacgcacacgtagactgcccgggccacgccgactatgttaaaaacatgatcaccggtgctgctcagatggatggcgcaatcctggttgttgctgcga

SEQ ID NO: 11 - DNA, 2827 bp, Enterobacter sp SA187
gtcagggagaactcatctcggggcaagtttcgtgcttagatgctttcagcacttatctcttccgcatttagctaccgggcaatgccattggcatgacaacccgaacaccagtgatgcgtccactccggtcctctcgtactaggagcagcccccctcaattctccagcgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgcgccgtcacgctcgcagtcaagctagcttatgccattgcactaacctcctgatgtccgaccaggattagctaaccttcgtgctcctccgttacgctttaggaggagaccgccccagtcaaactacccaccagacactgtccgcaacccggattacgggtccacgttagaacaccagccattaaagggtggtatttcaaggatggctccacgcagactggcgtccacgcttcaaagcctcccacctatcctacacatcaaggaccagtgttcagtgtcaagctatagtaaaggttcacggggtctttccgtcttgccgcgggtacactgcatcttcacagcgatttcaatttcactgagtctcgggtggagacagcctggccatcattacgccattcgtgcaggtcggaacttacccgacaaggaatttcgctaccttaggaccgttatagttacggccgccgtttaccggggcttcgatcaagagcttcgcgttgccgctaaccccatcaattaaccttccggcaccgggcaggcgtcacaccgtatacgtccactttcgtgtttgcacagtgctgtgtttttaataaacagttgcagccagctggtatcttcgactggtttcagctccgcgagcaagtcgcttcacctacgcaccagcgtgccttctcccgaagttacggcaccattttgcctagttccttcacccgagttctctcaagcgccttggtattctctacctgaccacctgtgtcggtttggggtacgattctgtgttacctgatgcttagaggcttttcctggaagcagggcatttgtcacttcagcaccgtagtgcctcgtcgtcacgcctcagtgttaaagtgaaccggatttacctggaacacacacctacacgcttaaaccgggacaaccgtcgcccggccaacatagccttctccgtccccccttcgcagtaacaccgagtacaggaatattaacctgtttcccatcgactacgcctttcggcctcgccttaggggtcgactcaccctgccccgattaacgttggacaggaacccttggtcttccggcgagcgggtttttcacccgctttatcgttacttatgtcagcattcgcacttctgatacctccagcagacctcacagtccaccttcaacggcttacagaacgctcccctacccaacaacacatagtgtcgctgccgcagcttcggtgcatggtttagccccgttacatcttccgcgcaggccgactcgaccagtgagctattacgctttctttaaatgatggctgcttctaagccaacatcctggctgtctgtgccttcccacatcgtttcccacttaaccatgactttgggaccttagctggcggtctgggttgtttccctcttcacgacggacgttagcacccgccgtgtgtctcccgtgataacattcttcggtattcgcagtttgcatcgggttggtaagtcgggatgaccccctagccgaaacagtgctctacccccgaagatgaattcacgaggcgctacctaaatagctttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccctgcaacttaacgcccagttaagactcggtttcccttcggctcccctatacggttaaccttgctacagaatataagtcgctgacccattatacaaaaggtacgcagtcaccccataaagaggctcccactgcttgtacgtacacggtttcaggttctgtttcactcccctcgccggggttcttttcgcctttccctcacggtactggttcactatcggtcagtcaggagtatttagccttggaggatggtccccccatattcagacaggataccacgtgtcccgccctactcttcgaactcacaacatgtgcatttttgtgtacgggagtatcaccctgtaccctgcgactttccagacgcttccactaacacacatgctgattcaggttctgggctcctccccgttcgctcgccgctactgggggaatctcggttgatttcttttcctcggggtacttagatgtttcagttcccccggttcgcctcatgccactatgtattcatgacatgatagtgcaacggattgcactgggtttccccattcgggtatcgccggttataacggttcatatcaccttaccggcgcttatcgcagattagcacgcccttcatcgcctctgactgccagggcatccaccgtgtacgcttagtcgcttaacctcacaacccgaagatgtttcacttctgattgc

SEQ ID NO: 12 - DNA, 1727 bp, Enterobacter sp SA187
tcggtttaggaaaagcagatggtgtgactttcacgaacctggatctgagtcttaaagggggtagctcaggcatcttgaccctgaaccagttagcaactgattcaaccttttccggtgggagtcggttttatcacgaaactcagtcaggagttcacaaaacgaccattcatacttattcagccggttattcgaaaaataattatgtccaaatatcggaagacggagatctcaccggaattcgtaactctaacggtctgaacttttttgcaggagagcgtggttttcgtggtaattgtcttcaaactggatggggtggggagggagatattctgaatgttcctttctttggaaatatagtaagaggtaatgatggcggttggtcaccaatagtatcaggtggttcaagtgctacgggcggttatcagactcataccgcattcggagcaattgcaaatggcgctactacatgggccagtgccgctataaagattttaggcgataacatttatcatagagcatttattttcacacataacggtgacatttccacatgggggcaaggagcaaatttagaagggaattatatatttcaaaaagcagctaattcagaccgagatataaagcaagacattgaatatacaaaaggcaaggaaagctatgaccgtgtcatgaaatggatgcctacatcattcaaatataaaggatctgaaattcagcgatatggtttaattgctcaggatctagctaaaatcgatctggaatatgttaagttggttcctggaaatcccattatcgaaacggtaatgaaaaatagtgataaagaagaagcagagatacctacctcagtaattgttgattatcaagatgatacactagctcttgatacaaatgttatgttagctgacatggcctgcgcgatggtattcatgggaaacaagattgaggaaatggaagccaaaattgaaagactattaaagaaacagtagttgataagaattttctatcgcacacttttacaatgcaacgatacttttgaaagtcagtctttgagggaaacgtgtgcgatagtttacttttttatttttcttccagttctttgaccctgcgaagtaattgctgcactaccggaacaagataagccgccgctgtttcagcaacattaacaatcatgccgtcctcgatcataccgcctccatcaacatccatcagcggcgaccgttctatgagttcggggaaccgctcataaatatcctgcgcccgaaaacccactctcattgcatcgggggtccacttcagtgaataaacgatagattcccactcactgataaatgcaatcgcctcctgttcagtaatcacccttttttcatttttaacgcgaatatcagaaacaccgggggtaaaggttcctgcatgagaagtgatagcaccggaaccattctggaatttccagtatttcgtataattatttccgtcagttgaaatcaaggctggccctgaatttgttgctgttccgtcagccccaatggagtaacagaaagaggtgtacatcgtcagaccgttgtgcatggttttcgcagtaacagctttattgttataagaaacgttagatccagcatccagcgtaacgattaacgccttatcaggtacccactgatcacgcatgatcgtagtcgtgaggcctgttgccgatgtaatgtcggtattcattccggatgcggctaaaccga

SEQ ID NO: 13 - DNA, 1641 bp, Enterobacter sp SA187
gacgctaaatgaataccaagtctctggagtgaacatacgtaattcattacgaagtttaattcacgagcatcaaacttaaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcatatacaaagagaagcgacctcgcgagagcaagcggacctcataaagtatgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaaagaacctgccttgcagtg

SEQ ID NO: 14 - DNA, 20 bp, Artificial sequence
  Synthetic primer
agagtttgatcctggctcag

SEQ ID NO: 15 - DNA, 22 bp, Artificial sequence
  Synthetic primer
tacggytaccttgttacgactt

SEQ ID NO: 16 - DNA, 20 bp, Artificial sequence
  Synthetic primer
tggttcgtccacggagaatg

SEQ ID NO: 17 - DNA, 20 bp, Artificial sequence
  Synthetic primer
cccattgacgtaactggcct

SEQ ID NO: 18 - DNA, 20 bp, Artificial sequence
  Synthetic primer
gcaagcgaagctggaatcag

SEQ ID NO: 19 - DNA, 20 bp, Artificial sequence
  Synthetic primer
aatcccattgccggtagcaa

SEQ ID NO: 20 - DNA, 20 bp, Artificial sequence
  Synthetic primer
actagcaaacccagtggctc

SEQ ID NO: 21 - DNA, 20 bp, Artificial sequence
  Synthetic primer
catgcccagacatcggagtt

SEQ ID NO: 22 - DNA, 20 bp, Artificial sequence
  Synthetic primer
atcgctacgcctgaataccg

SEQ ID NO: 23 - DNA, 20 bp, Artificial sequence
  Synthetic primer
ccaggaatcggaggaagctc

SEQ ID NO: 24 - DNA, 20 bp, Artificial sequence
  Synthetic primer
agtcgagcactggacaaagg

SEQ ID NO: 25 - DNA, 20 bp, Artificial sequence
  Synthetic primer
tagctcaacttctccaccgc

SEQ ID NO: 26 - DNA, 20 bp, Artificial sequence
  Synthetic primer
ctgtgccaaagttggtgctc

SEQ ID NO: 27 - DNA, 20 bp, Artificial sequence
  Synthetic primer
gtaacgtccacatcgcttgc

SEQ ID NO: 28 - DNA, 20 bp, Artificial sequence
  Synthetic primer
tacgtggggccaaaggattc

SEQ ID NO: 29 - DNA, 20 bp, Artificial sequence
  Synthetic primer
ccctcctcctccagacatga

SEQ ID NO: 30 - DNA, 20 bp, Artificial sequence
  Synthetic primer
caacccgtcttctccgaaca

SEQ ID NO: 31 - DNA, 20 bp, Artificial sequence
  Synthetic primer
cggtgcttgttgtccaaagg

SEQ ID NO: 32 - DNA, 20 bp, Artificial sequence
  Synthetic primer
ccgtcggttacaagtgtgga

SEQ ID NO: 33 - DNA, 22 bp, Artificial sequence
  Synthetic primer
aggcccaatgttatctccttca

SEQ ID NO: 34 - DNA, 20 bp, Artificial sequence
  Synthetic primer
ttggttcgacccttctcgtg

SEQ ID NO: 35 - DNA, 20 bp, Artificial sequence
  Synthetic primer
ccctgatgggcacattgtct

SEQ ID NO: 36 - DNA, 20 bp, Artificial sequence
  Synthetic primer
tggatgcgagaacggacaaa

SEQ ID NO: 37 - DNA, 20 bp, Artificial sequence
  Synthetic primer
catggtcgatctccgggaag

SEQ ID NO: 38 - DNA, 20 bp, Artificial sequence
  Synthetic primer
gagtctggtcttgcctccac

SEQ ID NO: 39 - DNA, 20 bp, Artificial sequence
  Synthetic primer
atgcgtctcaagaaaggggg

SEQ ID NO: 40 - DNA, 20 bp, Artificial sequence
  Synthetic primer
ccaacgcaaaccacctcttg

SEQ ID NO: 41 - DNA, 20 bp, Artificial sequence
  Synthetic primer
cagccgcatacttaccccat

SEQ ID NO: 42 - DNA, 20 bp, Artificial sequence
  Synthetic primer
ggtgtttctacgacggggtt

SEQ ID NO: 43 - DNA, 20 bp, Artificial sequence
  Synthetic primer
ttagcttcccaacgtcgctt

SEQ ID NO: 44 - DNA, 20 bp, Artificial sequence
  Synthetic primer
ggcgattctgaatttcccgc

SEQ ID NO: 45 - DNA, 20 bp, Artificial sequence
  Synthetic primer
ttgtacaggccacgaccatc

SEQ ID NO: 46 - DNA, 20 bp, Artificial sequence
  Synthetic primer
ctttcgacgccgctcaattt

SEQ ID NO: 47 - DNA, 20 bp, Artificial sequence
  Synthetic primer
ggaggcgtcaacgacttttc

SEQ ID NO: 48 - DNA, 20 bp, Artificial sequence
  Synthetic primer
attgcagacgtgtcggttct

SEQ ID NO: 49 - DNA, 20 bp, Artificial sequence
  Synthetic primer
cagcacagtgaagcggagta
